United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 50

SEQ ID NO: 232837 - protein, 877 aa, Glycine max
  Coding DNA Sequence Number=SeqID_116059
  Gene Ontology: Mol. function=protein binding; Cellular component =integral to membrane; Biological process=defense response to fungus
  Homolog annotation: Hit_ID=Q1S5Q4; Match level="QueryCoverage=98%, HitCoverage=96%, E-value=0.0, Identity=44%"; Hit description=Leucine- rich repeat
  Pfam annotation: Domain name=LRRNT_2; Domain location=15-54; Score =53.7; E_value=6.1e-13; Accession=PF08263.3; Description=Leucine rich repeat N-terminal domain
  Pfam annotation: Domain name=LRR_1; Domain location=100-118; Score =3.0; E_value=79; Accession=PF00560.23; Description=Leucine Rich Repeat
  Pfam annotation: Domain name=LRR_1; Domain location=141-164; Score =3.4; E_value=66; Accession=PF00560.23; Description=Leucine Rich Repeat
  Pfam annotation: Domain name=LRR_1; Domain location=166-187; Score =4.3; E_value=45; Accession=PF00560.23; Description=Leucine Rich Repeat
  Pfam annotation: Domain name=LRR_1; Domain location=192-210; Score =3.0; E_value=79; Accession=PF00560.23; Description=Leucine Rich Repeat
  Pfam annotation: Domain name=LRR_1; Domain location=217-239; Score =14.8; E_value=0.31; Accession=PF00560.23; Description=Leucine Rich Repeat
  Pfam annotation: Domain name=LRR_1; Domain location=242-264; Score =8.9; E_value=6.1; Accession=PF00560.23; Description=Leucine Rich Repeat
  Pfam annotation: Domain name=LRR_1; Domain location=266-288; Score =10.6; E_value=2.9; Accession=PF00560.23; Description=Leucine Rich Repeat
  Pfam annotation: Domain name=LRR_1; Domain location=290-312; Score =21.1; E_value=0.0041; Accession=PF00560.23; Description=Leucine Rich Repeat
  Pfam annotation: Domain name=LRR_1; Domain location=314-336; Score =9.4; E_value=5; Accession=PF00560.23; Description=Leucine Rich Repeat
  Pfam annotation: Domain name=LRR_1; Domain location=338-361; Score =5.4; E_value=28; Accession=PF00560.23; Description=Leucine Rich Repeat
  Pfam annotation: Domain name=LRR_1; Domain location=409-431; Score =2.4; E_value=1e+02; Accession=PF00560.23; Description=Leucine Rich Repeat
  Pfam annotation: Domain name=LRR_1; Domain location=434-453; Score =4.1; E_value=49; Accession=PF00560.23; Description=Leucine Rich Repeat
  Pfam annotation: Domain name=LRR_1; Domain location=476-498; Score =8.7; E_value=6.6; Accession=PF00560.23; Description=Leucine Rich Repeat
  Pfam annotation: Domain name=LRR_1; Domain location=504-523; Score =8.4; E_value=7.8; Accession=PF00560.23; Description=Leucine Rich Repeat
  Pfam annotation: Domain name=LRR_1; Domain location=528-550; Score =17.0; E_value=0.066; Accession=PF00560.23; Description=Leucine Rich Repeat
  Pfam annotation: Domain name=LRR_1; Domain location=552-573; Score =10.8; E_value=2.7; Accession=PF00560.23; Description=Leucine Rich Repeat
  Pfam annotation: Domain name=LRR_1; Domain location=575-596; Score =10.5; E_value=3.1; Accession=PF00560.23; Description=Leucine Rich Repeat
  Pfam annotation: Domain name=LRR_1; Domain location=597-619; Score =9.0; E_value=6; Accession=PF00560.23; Description=Leucine Rich Repeat
  Pfam annotation: Domain name=LRR_1; Domain location=621-643; Score =7.4; E_value=12; Accession=PF00560.23; Description=Leucine Rich Repeat
  Pfam annotation: Domain name=LRR_1; Domain location=687-709; Score =5.9; E_value=22; Accession=PF00560.23; Description=Leucine Rich Repeat
  Pfam annotation: Domain name=LRR_1; Domain location=711-733; Score =16.8; E_value=0.079; Accession=PF00560.23; Description=Leucine Rich Repeat
  Pfam annotation: Domain name=LRR_1; Domain location=735-757; Score =14.5; E_value=0.38; Accession=PF00560.23; Description=Leucine Rich Repeat
  Pfam annotation: Domain name=LRR_1; Domain location=759-780; Score =8.9; E_value=6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1; Domain ...
  Pfam module annotation: Pfam domain module=location=15-54::100 -118::141-164::166-187::192-210::217-239::242-264::266-288::290 -312::314-336::338-361::409-431::434-453::476-498::504-523::528 -550::552-573::575-596::597-619:...
  Pfam module annotation: =:621-643::687-709::711-733::735-757::759-780
MLFYSVMCSSKIHCNEKDMNTLLRFKTGVTDPSGVLSSWFPKLDCCQWTGVKCDNITGRVTHLNLPCHTTQPKVVALDEKDDKSHCLTGEFSLTLLELEFLWYLDFSNNDFKSIQYNSMGSQKCDQLSRGNLPHLCRNSTNLRLLDLSLNYDLLVDNLHWISRLSSLQYLSLEGVHLHKEIDWLQSVTMLPSLIEFHLQRCQLENIYPFLQYANFTSLQALNLSGNDFESELPSWLFNLSCDISYIDLSQNKIHSQLPKTLPNLRRVKFLILSQNYLKGPIPNWLGQLEQLQELDLSDNFFSGPIPASLGNLSSLTDLALDSNELNGNLPDNLGNLFNLETLSILKNSLTGIVSERNLLSFSKLRWFAMSSPGLIFDFDPEWIPPFQLQHLTLGYVRDKLPAWLFTQSSLEYLIIEDSTASFEPLDKFWNFATQLKFFFLVNNTINGDISNVLLSSERVWLVSNNLRGGMPRISPDVVVLTLYNNSLSGSISPLLCDNRIDKSNLVHLDMGYNHLTGELTDCWNDWKSLVHIDLSYNNLTGKIPHSMGSLSNLRFLYLESNKFFGEVSSLNNCKNLWILDLGHNNLSGVIPNWLGQSVRGLKLRSNQFSGNIPTQLCQLGSLMVMDFAGNRLSGPIPNCLHNFTAMLFSNASTLKVGYIVHLPGFPVIMTASITILIKGNELEYFNLMNVIDLSNNILSGSVPLEIYMLTGLQSLNLSHNQLLGTIPQEIGNLEALESIDLSRNQFSGEIPESMAVLHYLSVLNLSFNNFVGKIPTGTQLGSTNLSYIGNPLLCGAPLTKICPQDEKSNNTKHAGEEDDDDKSELYSWFYMGLGIGFAVGFLGVLGAIFFNQRCRHAYFRFLHRMYDFVIQKMNSIY

SEQ ID NO: 232838 - protein, 884 aa, Glycine max
  Coding DNA Sequence Number=SeqID_116060
  Gene Ontology: Mol. function=protein binding; Cellular component =integral to membrane; Biological process=defense response to fungus
  Homolog annotation: Hit_ID=Q1S5Q9; Match level="QueryCoverage=92%, HitCoverage=99%, E-value=0.0, Identity=46%"; Hit description=Leucine- rich repeat
  Pfam annotation: Domain name=LRRNT_2; Domain location=60-99; Score =45.3; E_value=2.1e-10; Accession=PF08263.3; Description=Leucine rich repeat N-terminal domain
  Pfam annotation: Domain name=LRR_1; Domain location=145-168; Score =5.1; E_value=31; Accession=PF00560.23; Description=Leucine Rich Repeat
  Pfam annotation: Domain name=LRR_1; Domain location=170-191; Score =3.0; E_value=78; Accession=PF00560.23; Description=Leucine Rich Repeat
  Pfam annotation: Domain name=LRR_1; Domain location=196-214; Score =5.6; E_value=25; Accession=PF00560.23; Description=Leucine Rich Repeat
  Pfam annotation: Domain name=LRR_1; Domain location=221-243; Score =13.9; E_value=0.59; Accession=PF00560.23; Description=Leucine Rich Repeat
  Pfam annotation: Domain name=LRR_1; Domain location=246-268; Score =10.3; E_value=3.4; Accession=PF00560.23; Description=Leucine Rich Repeat
  Pfam annotation: Domain name=LRR_1; Domain location=270-292; Score =13.7; E_value=0.68; Accession=PF00560.23; Description=Leucine Rich Repeat
  Pfam annotation: Domain name=LRR_1; Domain location=294-316; Score =21.9; E_value=0.0023; Accession=PF00560.23; Description=Leucine Rich Repeat
  Pfam annotation: Domain name=LRR_1; Domain location=318-340; Score =10.0; E_value=3.8; Accession=PF00560.23; Description=Leucine Rich Repeat
  Pfam annotation: Domain name=LRR_1; Domain location=342-365; Score =9.2; E_value=5.5; Accession=PF00560.23; Description=Leucine Rich Repeat
  Pfam annotation: Domain name=LRR_1; Domain location=438-457; Score =5.8; E_value=24; Accession=PF00560.23; Description=Leucine Rich Repeat
  Pfam annotation: Domain name=LRR_1; Domain location=480-503; Score =12.2; E_value=1.5; Accession=PF00560.23; Description=Leucine Rich Repeat
  Pfam annotation: Domain name=LRR_1; Domain location=508-529; Score =6.5; E_value=17; Accession=PF00560.23; Description=Leucine Rich Repeat
  Pfam annotation: Domain name=LRR_1; Domain location=532-554; Score =11.5; E_value=2; Accession=PF00560.23; Description=Leucine Rich Repeat
  Pfam annotation: Domain name=LRR_1; Domain location=556-578; Score =11.9; E_value=1.7; Accession=PF00560.23; Description=Leucine Rich Repeat
  Pfam annotation: Domain name=LRR_1; Domain location=580-601; Score =9.5; E_value=4.8; Accession=PF00560.23; Description=Leucine Rich Repeat
  Pfam annotation: Domain name=LRR_1; Domain location=602-624; Score =9.0; E_value=6; Accession=PF00560.23; Description=Leucine Rich Repeat
  Pfam annotation: Domain name=LRR_1; Domain location=626-648; Score =6.2; E_value=20; Accession=PF00560.23; Description=Leucine Rich Repeat
  Pfam annotation: Domain name=LRR_1; Domain location=692-714; Score =5.9; E_value=22; Accession=PF00560.23; Description=Leucine Rich Repeat
  Pfam annotation: Domain name=LRR_1; Domain location=716-738; Score =17.1; E_value=0.063; Accession=PF00560.23; Description=Leucine Rich Repeat
  Pfam annotation: Domain name=LRR_1; Domain location=740-762; Score =16.8; E_value=0.08; Accession=PF00560.23; Description=Leucine Rich Repeat
  Pfam annotation: Domain name=LRR_1; Domain location=764-785; Score =8.9; E_value=6.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1; Domain location=...
  Pfam module annotation: Domain location=60-99::145-168::170-191::196 -214::221-243::246-268::270-292::294-316::318-340::342-365::438 -457::480-503::508-529::532-554::556-578::580-601::602-624::626 -648::692-714::716-738::740-762::764-785
MEDLVEYKNINTCSGFYLYLPIINTSSCVIMGASPLGIKPLLLSLLLCAFMCSSLKIHCNEKDMNKLLRFKKGVRDPSGMLSSWLPKLDCCRWTGVKCDNITGRVTQLSLPCHTTQPEVVAYQEKDDKSHCLTGNLPHLCGNSTNLHYLDLSHNYDLLVYNLHWVSRLSSLKYLNLGGVHLPKEIDWLQSVTMLPSLLELTLENCQLENIYPFLQYANFTSLQVLNLAGNDFVSELPSWLFNLSCDISHIDLSQNRINSQLPERFPNFRSIQTLFLSDNYLKGPIPNWLGQLEELKELDLSHNSFSGPIPEGLGNLSSLINLILESNELNGNLPDNLGHLFNLETLAVSKNSLTGIVSERNLRSLTNLKSFSLGSPALVYDFDPEWVPPFQLVSISLGYVRDKLPAWLFTQSSLTDLKILDSTASFEPLDKFWNFATQLEYFVLVNNTINGDISNVLLSSKLVWLDSNNLRGGMPRISPEVRVLRIYNNSLSGSISPLLCDNMKNKSNLVYLGMGYNHFSGELTDCWNNWKSLVLIDFGYNNLTGNIPHSMGSLSNLRFVYLESNKLFGEVPFSLKNCQNLWILDIGDNNLSGVIPSWWGQSVRGLKLRSNQFSGNIPTQLCQLGSLMVMDFASNRLSGPIPNCLHNFTAMLFSNASTYKVGFTVQSPDFSVSIACGIRMFIKGKELNRVYLMNDIDLSNNNLSGSVPLEIYMLTGLQSLNLSHNQLMGTIPQEIGNLKQLEAIDLSRNQFSGEIPVSLSALHYLSVLNLSFNNLMGKIPSGTQLGSTDLSYIGNSDLCGPPLTKICPQDEKSHNITKPVREEDDDDDKSEVYSWFYMGMGIGFAVGFWGVFGTILFNRRCRHVYFRFLHRMYDFVIRKMTSIY

SEQ ID NO: 232839 - protein, 237 aa, Glycine max
  Coding DNA Sequence Number=SeqID_116061
  Gene Ontology: Mol. function=binding; Cellular component =intracellular; Biological process=metabolic process
  Homolog annotation: Hit_ID=Q9FND6; Match level="QueryCoverage=90%, HitCoverage=53%, E-value=1e-51, Identity=41%"; Hit description =Selenium-binding protein-like
  Pfam annotation: Domain name=PPR; Domain location=38-72; Score=31.8; E_value=2.4e-06; Accession=PF01535.11; Description=PPR repeat
MEIMIPFFFFFWFSRNIQSPLLNVSHKVFAEIGKPDKVALTAMLAGYAMHGQGKEAIEFFQRTVLEGMKPDHVTFALLSACSHSGLVKEGKVYRNINLGKEAAENLIALNPSDPRNYIMLSNIYSAADKIHKKLEEIMRKIQEVGFVSETESILHDVDEEVKTDMINKHSEKIALAFGLLVSNADMPLVIIKNLQISQDCLNTAKFVSLIEKCTITIRDSKRFHHFSDASCSCGDYW

SEQ ID NO: 232840 - protein, 150 aa, Glycine max
  Coding DNA Sequence Number=SeqID_116062
  Homolog annotation: Hit_ID=Q9LEU7; Match level="QueryCoverage=49%, HitCoverage=16%, E-value=3e-07, Identity=51%"; Hit description =Serine/threonine protein kinase-like protein
  Subcellular localization annotation: CTP_CleavageSite=35; ConfidenceScore=5.30e-01
MANLTKRTMIFAITRVSCWRNKRPLRLRRKKIISRCPSSSTHLSLFRPCLSGRPLEDVREQEEDNGGVHVEVLYGGDCGEDCSGGVGAEVPRGGGQGLQDPVAGCGGGEEGEAGVIVEVFKVALEVTFATKTVEGEGFCYNRYPKQIPIV

SEQ ID NO: 232841 - protein, 849 aa, Glycine max
  Coding DNA Sequence Number=SeqID_116063
  Gene Ontology: Mol. function=protein binding; Cellular component =integral to membrane; Biological process=defense response to fungus
  Homolog annotation: Hit_ID=Q1S5Q9; Match level="QueryCoverage=95%, HitCoverage=94%, E-value=0.0, Identity=46%"; Hit description=Leucine- rich repeat
  Pfam annotation: Domain name=LRRNT_2; Domain location=36-75; Score =53.7; E_value=6.1e-13; Accession=PF08263.3; Description=Leucine rich repeat N-terminal domain
  Pfam annotation: Domain name=LRR_1; Domain location=121-156; Score =4.9; E_value=34; Accession=PF00560.23; Description=Leucine Rich Repeat
  Pfam annotation: Domain name=LRR_1; Domain location=162-185; Score =6.0; E_value=22; Accession=PF00560.23; Description=Leucine Rich Repeat
  Pfam annotation: Domain name=LRR_1; Domain location=187-208; Score =5.5; E_value=27; Accession=PF00560.23; Description=Leucine Rich Repeat
  Pfam annotation: Domain name=LRR_1; Domain location=213-233; Score =5.9; E_value=23; Accession=PF00560.23; Description=Leucine Rich Repeat
  Pfam annotation: Domain name=LRR_1; Domain location=238-260; Score =14.1; E_value=0.51; Accession=PF00560.23; Description=Leucine Rich Repeat
  Pfam annotation: Domain name=LRR_1; Domain location=263-285; Score =7.1; E_value=13; Accession=PF00560.23; Description=Leucine Rich Repeat
  Pfam annotation: Domain name=LRR_1; Domain location=287-309; Score =12.7; E_value=1.2; Accession=PF00560.23; Description=Leucine Rich Repeat
  Pfam annotation: Domain name=LRR_1; Domain location=311-333; Score =18.0; E_value=0.035; Accession=PF00560.23; Description=Leucine Rich Repeat
  Pfam annotation: Domain name=LRR_1; Domain location=335-357; Score =13.4; E_value=0.82; Accession=PF00560.23; Description=Leucine Rich Repeat
  Pfam annotation: Domain name=LRR_1; Domain location=359-382; Score =11.7; E_value=1.8; Accession=PF00560.23; Description=Leucine Rich Repeat
  Pfam annotation: Domain name=LRR_1; Domain location=430-452; Score =1.0; E_value=1.9e+02; Accession=PF00560.23; Description=Leucine Rich Repeat
  Pfam annotation: Domain name=LRR_1; Domain location=455-474; Score =4.1; E_value=49; Accession=PF00560.23; Description=Leucine Rich Repeat
  Pfam annotation: Domain name=LRR_1; Domain location=497-519; Score =8.7; E_value=6.6; Accession=PF00560.23; Description=Leucine Rich Repeat
  Pfam annotation: Domain name=LRR_1; Domain location=525-544; Score =8.4; E_value=7.8; Accession=PF00560.23; Description=Leucine Rich Repeat
  Pfam annotation: Domain name=LRR_1; Domain location=549-571; Score =17.0; E_value=0.066; Accession=PF00560.23; Description=Leucine Rich Repeat
  Pfam annotation: Domain name=LRR_1; Domain location=573-595; Score =13.1; E_value=1; Accession=PF00560.23; Description=Leucine Rich Repeat
  Pfam annotation: Domain name=LRR_1; Domain location=597-618; Score =11.0; E_value=2.5; Accession=PF00560.23; Description=Leucine Rich Repeat
  Pfam annotation: Domain name=LRR_1; Domain location=619-641; Score =6.4; E_value=18; Accession=PF00560.23; Description=Leucine Rich Repeat
  Pfam annotation: Domain name=LRR_1; Domain location=643-665; Score =6.2; E_value=20; Accession=PF00560.23; Description=Leucine Rich Repeat
  Pfam annotation: Domain name=LRR_1; Domain location=709-731; Score =5.9; E_value=22; Accession=PF00560.23; Description=Leucine Rich Repeat
  Pfam annotation: Domain name=LRR_1; Domain location=733-755; Score =16.8; E_value=0.079; Accession=PF00560.23; Description=Leucine Rich Repeat
  Pfam annotation: Domain name=LRR_1; Domain location=757-779; Score =12.9; E_value=1.1; Accession=PF00560.23; Description=Leucine Rich Repeat
  Pfam annotation: Domain name=LRR_1; Domain location=781-802; Score =8.9; E_value=6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1; Domain ...
  Pfam module annotation: Pfam domain module=location=36-75::121 -156::162-185::187-208::213-233::238-260::263-285::287-309::311 -333::335-357::359-382::430-452::455-474::497-519::525-544::549 -571::573-595::597-618::619-641:...
  Pfam module annotation: =:643-665::709-731::733-755::757-779::781-802
MDASPSSMKLLKFLLLCLLCTILFNSVMCSSKIHCNEKDMNTLLRFKTGVTDPSGVLSSWFPKLDCCQWTGVKCDNITGRVTHLNLPCHTTQPKIVALDEKDDKSHCLTGEFSLTLLELEFLSYLNFSNNDFKSIQYNSMGGKKCDHLSRGNLPHLCRNSTNLHYLDLSFNYDLLVDNLHWISRLSSLQYLNLDGVHLHKEIDWLQSVTMLPSLLELHLQRCQLENIYPFLHYANFTSLRVLNLADNDFLSELPIWLFNLSCDISYIELSKNQIHSQLPKTLPNLRSIKSLFLSKNHLKGPIPNWLGQLEQLEELDFSQNFLSGPIPTSLGNLSSLTTLVLDSNELNGNLPDNLRNLFNLETLSISKNSLTGIVSERNLLSFSKLRWFKMSSPGLIFDFDPEWVPPFQLQLLELGYVRDKLPAWLFTQSSLKYLTIVDSTASFEPLDKFWNFATQLKFFFLVNNTINGDISNVLLSSECVWLVSNNLRGGMPRISPDVVVLTLYNNSLSGSISPLLCDNRIDKSNLVHLDMGYNHLTGELTDCWNDWKSLVHIDLSYNNLTGKIPHSMGSLSNLRFLYLESNKFFGKVPFSLNNCKNLWVLDLGHNNLSGVIPNWLGQSVRGVKLRSNQFSGNIPTQLCQLGSLMVMDFASNRLSGPIPNCLHNFTAMLFSNASTLKVGYMVHLPGLPIIITCSITMLIKGNELEYFNLMNVIDLSNNILSGSVPLEIYMLTGLQSLNLSHNQLLGTIPQEIGNLELLESIDLSRNQFSGEIPESMADLHYLSVLNLSFNNFVGKIPTGTQLGSTNLSYIGNPHLCGAPLTKICPQDEKSNNTKHAGEEDDDDKSELYS

SEQ ID NO: 232842 - protein, 79 aa, Glycine max
  Coding DNA Sequence Number=SeqID_116064
MEVLTPKGWWQQRRWRRRCRDFITMERFELWILLTQREGVVRQIKNQRERTFNTMKLVWSPESALKSYIETVKSLKQLV

SEQ ID NO: 232843 - protein, 550 aa, Glycine max
  Coding DNA Sequence Number=SeqID_116065
  Gene Ontology: Mol. function=protein binding; Cellular component =integral to membrane; Biological process=protein transport
  Homolog annotation: Hit_ID=Q2NX24; Match level="QueryCoverage=87%, HitCoverage=77%, E-value=1e-167, Identity=62%"; Hit description =Flagellar protein FlhA
  Pfam annotation: Domain name=FHIPEP; Domain location=18-498; Score =448.7; E_value=7.5e-132; Accession=PF00771.10; Description=FHIPEP family
MAGAGWSGADHADPVNDGIAAAGRTLEFAAFPTILLFSTLLRLALNVASTRIILLEGHTGADAAGRVVEAFGHFLVGGNFAIGIVVFIILVIINFMVITKGAGRIAEVGARFVLDGMPGKQMAIDADLNAGLIGEDEAKRRRTEVTQEADFYGSMDGASKFVRGDAIAGILIMVINVIGGLLVGVVQHGMDLGHAGETYTLLTIGDGLVAQIPALVISTAAGVIVTRVSTDQDVGEQMCRRDWPAGPGARHAELCVPAVHRGAARPGLETPATVEASWTDVQLEDSLGMEVGYRLIPMVDHLQNGELLGRIRSIRKKVAQEVGFLPPVVHIRDNMELPPARYRILMKGVEIGSGDAYPGRWMAINPGTAAGTLPGEATVDPAFGLAAIWIDSALKEQAQIQGYTVVEARSAAAAGPRHPGDAKADGRSGAGRHYPDHAAQSAAKSADRARLDPRHAHHYRNAGRTCAGAERSAGTDQRGTRRAGPRDYPAVVPGQRRSAGDWTGCHTGASAAAGAAGWWRSGTGSCRSTADAGAGRAAAAGDDRCAAGAA

SEQ ID NO: 232844 - protein, 92 aa, Glycine max
  Coding DNA Sequence Number=SeqID_116066
MIKEGLHIYLAPQTLTKEEVMQSYPARALGRRLQVDWARDPREGPRVLMSLRVDFEPMGYYFYFKAHENLNPRENSSKVSATKNNRTKLKGT

SEQ ID NO: 232845 - protein, 192 aa, Glycine max
  Coding DNA Sequence Number=SeqID_116067
MGRKELHHQDEPWIRSLEGCFNGGKERERGEHEIEGLKEGEKWNFEDCIRKQAEQETQRWKVCSIVPQGPHTLQMNQTNFHPLLITICSKEMETYEPETEIEEEKSISGEDSPTTPMQNQTPSKVEADAFEKIASISQTLTTTKQSLWKMDLHALGISYKIKRLKQQLVLVERLTRRQANDELAEITNDSKV

SEQ ID NO: 232846 - protein, 307 aa, Glycine max
  Coding DNA Sequence Number=SeqID_116068
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=2e-32, Identity=30%"; Hit description= UPI00006A17C9 related cluster
STLEDPTDESISYYLIRVDPWVLVPIAFRGLHVLPFRGLNVLAFRGLHALAFRGLHILSFRGLHVLAIRGLYVLGFRGLHVLAFRGLDVLLFRGLHVLYFRGLHVLAFRGLYVLAFRGLHVLPFRGLQSSPSEGSTPLPSKYCMSSPSEGYTPSPLESYTPLPLEDCTCSPSESYTPSPLEDYTSLPSEDCTSSPSGDHTSSPSESLTSLPTEGHTSLPSEGYTPSPSEDCTSSPSGDYMPSSLEGFASSPAEGYTPSPLQGYTPSPSERCMPSPSEGYTSSPSEGCTPSPLEGYTFWPSEGYTPSP

SEQ ID NO: 232847 - protein, 193 aa, Glycine max
  Coding DNA Sequence Number=SeqID_116069
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=9e-20, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAHHTPSASEGYKPSPSKDYTLLPSEDYTSSPLEGYTPSPSEGYTPTPSEDYTSSPSENYMSSPSEGYTSSPSEGYLPSLSEDYTSSPSKGCTPSPLENYTSSSSEDYTSSPFRGLDVLTFRGLHTLTFRGLYALAFRGLHVLAFKGLHALAFRGLHAFVFKGRHVLDFRGLYAPSPLEGYASSLSVGSISTP

SEQ ID NO: 232848 - protein, 71 aa, Glycine max
  Coding DNA Sequence Number=SeqID_116070
MEEDPKKTLKFLDATNAINLVTSKKIVPSNEEWPGEKYKVLFDYEKCVIKHEYDKDIEHIGFRENNVYMID

SEQ ID NO: 232849 - protein, 229 aa, Glycine max
  Coding DNA Sequence Number=SeqID_116071
  Gene Ontology: Mol. function=hydrolase activity, hydrolyzing O -glycosyl compounds; Cellular component=vacuole; Biological process =carbohydrate metabolic process
  Homolog annotation: Hit_ID=Q43684; Match level="QueryCoverage=89%, HitCoverage=68%, E-value=1e-105, Identity=88%"; Hit description =Basic chitinase class 3
  Pfam annotation: Domain name=Glyco_hydro_18; Domain location=29-229; Score=151.4; E_value=2.5e-42; Accession=PF00704.18; Description =Glycosyl hydrolases family 18
MAKSKNCHALPLLLALILFFTLLGTSHAGGIAIYWGQNGNEGTLSEACATGKYTHINIAFLNKFGNGQTPEMNLAGHCNPATNSCTKFSSEIKDCQSKGIKVLLSIGGGIGSYTLASVEDARNVSTFLWNTFLGGKSSSSSRPLGDAVLDGIDFDIELGSTQNYEHLARFLKAYSGVGGKRVYLGAAPQCPIPDRFLGTALNTGLFDFVWVQFYNNPPCQYANGNITNL

SEQ ID NO: 232850 - protein, 79 aa, Glycine max
  Coding DNA Sequence Number=SeqID_116072
  Gene Ontology: Mol. function=hydrolase activity, hydrolyzing O -glycosyl compounds; Cellular component=vacuole; Biological process =carbohydrate metabolic process
  Homolog annotation: Hit_ID=Q41401; Match level="QueryCoverage=81%, HitCoverage=19%, E-value=1e-23, Identity=75%"; Hit description =Chitinase homologue
MLILLKIFFFTIIKSSEASTGGIAIYWGQNNSDDTLSSTCHTANYEIVNLAFLSVFSCARTPSWNFAGHRGDRSPCTKL

SEQ ID NO: 232851 - protein, 236 aa, Glycine max
  Coding DNA Sequence Number=SeqID_116073
  Homolog annotation: Hit_ID=Q2JZQ6; Match level="QueryCoverage=84%, HitCoverage=88%, E-value=1e-14, Identity=28%"; Hit description =Hypothetical conserved protein
MSMRIALAVTVVLALSGCRIVSEKKLAELRSPVNPHVAQAAEIYRSQIAPQAVKTAQPLGELLARIAQAKDFDSACGLLGYRAQPEFPCYFNVKVSGEVAAVNTRSRSGKLTLKLTDAPLSSVEVQIGPVYRGTALRDSYRGLSYGDFNDQALFGDFARAINQASIDELAGSPPKVGDHITVYGVFSSWQAPAEPLLITPVNVLIGENGAGKSTMMKLLAGVTPRPPVPSSWRVKR

SEQ ID NO: 232852 - protein, 103 aa, Glycine max
  Coding DNA Sequence Number=SeqID_116074
MKKILGLQAPMELASTLVLILDDERLVFYKCLFLCLVLMVMIDIEIDSHPFHQSAEKEFGYQVQLKLGRKCVILENLSTTTKIESCPRALLGNPRCGAYKPLD

SEQ ID NO: 232853 - protein, 309 aa, Glycine max
  Coding DNA Sequence Number=SeqID_116075
  Gene Ontology: Mol. function=acid phosphatase activity; Cellular component=outer membrane
  Homolog annotation: Hit_ID=O66049; Match level="QueryCoverage=81%, HitCoverage=92%, E-value=3e-95, Identity=67%"; Hit description =Phytase
  Pfam annotation: Domain name=Acid_phosphat_B; Domain location=9-246; Score=291.6; E_value=1.5e-84; Accession=PF03767.5; Description=HAD superfamily, subfamily IIIB (Acid
MAGKQARTLTLGAAIGVALLTLAGCAQPPHTDAQAQQRLADQSVLAVNWFQQSGEYQALAHQAFNSAQRAFDQARAAPGRKKAVVVDLDETMLDNSAYSGWQAQQGQPYDGATWAKWTQAEQAGAVPGAVSFARYVNTHQGTMFYVSNRKQSEYAATVANMHKLGFTGMSEKTVLLSTDTSNKQARFDAIKQAGYDIVVYAGDNLNDFGAATYHQDNAQRRAFVSENQGKFGTEFIVLPNPLYGDWESGLARDYNKLTPQQKLQVASNAPPSLARAYCGMSPAASNPNWRYNPCAALPLRVSSTNRLRR

SEQ ID NO: 232854 - protein, 155 aa, Glycine max
  Coding DNA Sequence Number=SeqID_116076
MSLPSAVHVSSIIKREASGDWEARYCVVFRIGSFAKYKKKEGVETRVVITERAGRTKSVSYLCFPPISDERKKSKGSRLAQSVKFRNVAEVKRGVFAQSVSFRDFFERPTWAFQKIPPEGCCMCRKQPGSPGNYAKILDRSSRFIVRSSFSSVFN

SEQ ID NO: 232855 - protein, 258 aa, Glycine max
  Coding DNA Sequence Number=SeqID_116077
  Gene Ontology: Mol. function=transketolase activity; Cellular component=type II protein secretion system complex; Biological process=protein secretion by the type II secretion system
  Homolog annotation: Hit_ID=Q74XN1; Match level="QueryCoverage=93%, HitCoverage=78%, E-value=1e-48, Identity=39%"; Hit description=C -terminal region of transketolase
  Pfam annotation: Domain name=Transket_pyr; Domain location=1-112; Score=-29.2; E_value=0.00021; Accession=PF02779.14; Description =Transketolase, pyrimidine binding dom
  Pfam annotation: Domain name=Transketolase_C; Domain location=122 -240; Score=44.7; E_value=3.2e-10; Accession=PF02780.10; Description =Transketolase, C-terminal domain
  Pfam module annotation: Pfam domain module=Transket_pyr::Transketolase _C; Domain location=1-112::122-240
MVGMAAGMALSGRTVFTANAAPFLFARSNEQMKNDVCYTETNVKMLGLNAGFGYGPLGATHHCMNDIAIARTLGNLSVYAPADARQAAEIVRYVIAQPGPAYIRMDSDKLPVLNASYHFRPGEPEVLHQGSDSLVFCLGTVAHESMKVLELGDNPTIVSLPSLWPLNEAAVVALMRSHRRVLTMEEHALSGGLGTIIGELLLRHQLPRPFTALGVPAYEFTHSSSRAALRRQYAIDAAGLHAQLTPYGECDGAERIRR

SEQ ID NO: 232856 - protein, 74 aa, Glycine max
  Coding DNA Sequence Number=SeqID_116078
MRIIPHVLQRSRYGEAPVQIHVIALVGSREPTQGKTGTVESRLCQYNFPCGIRCTVLNPGRGDLLFDMPCLARP

SEQ ID NO: 232857 - protein, 133 aa, Glycine max
  Coding DNA Sequence Number=SeqID_116079
  Pfam annotation: Domain name=SNARE_assoc; Domain location=38-130; Score=-6.8; E_value=0.001; Accession=PF09335.1; Description=SNARE associated Golgi protein
  Subcellular localization annotation: CTP_CleavageSite=42; ConfidenceScore=5.08e-01
MAWFDHLLTHFALYPAHLFALLFVMALGKSTVLISSVLPPASVMLLAGIGVSQGSMHPGLAWLAVVMGATVGSVLNYHVGQLMGHTRLVTRFTSKHADSGDAQLSAVKVYAVSLLSACAWAALYVGIVAGISV

SEQ ID NO: 232858 - protein, 117 aa, Glycine max
  Coding DNA Sequence Number=SeqID_116080
  Homolog annotation: Hit_ID=Q8GZF0; Match level="QueryCoverage=27%, HitCoverage=2%, E-value=8e-08, Identity=84%"; Hit description =Resistance protein KR4
MKKILDDLDDLASQMDNLGLKKASDLVAGSGSGKFPAWEHMQIAGGNGAFPVNATAGHGVAINDGVLLELGLASQTGELMLGHCLPSLRVQQEVAERDRLFADESASATGDLGCSWE

SEQ ID NO: 232859 - protein, 220 aa, Glycine max
  Coding DNA Sequence Number=SeqID_116081
  Gene Ontology: Mol. function=rRNA (guanine-N2-)-methyltransferase activity; Biological process=DNA methylation
  Homolog annotation: Hit_ID=Q0S4C0; Match level="QueryCoverage=54%, HitCoverage=31%, E-value=7e-27, Identity=52%"; Hit description=RRNA (Guanine-N(2)-)-methyltransferase
MTAVAARTADFGSAAIEHRPYVHASSQHSTSKEGRGRGLVFGPSGPRSNVTKWPIRGKSRARDPPEFQRLTGGLRGRRTFPIDAREPQERRPPALRMLRVTVNFGVRSSCSVGPISRVSSARYPRAELYTVKSSPPGRRTRAVAWNRRVAAPVWTLAPRWNGGFNSTVSTLASGSSDAASSCMTVTRSATPFAAAVARADAAGAADRSVAMTTASGWVSA

SEQ ID NO: 232860 - protein, 111 aa, Glycine max
  Coding DNA Sequence Number=SeqID_116082
  Gene Ontology: Mol. function=nucleic acid binding; Biological process= RNA-dependent DNA replication
MEGNCSAVIQRILPPKHKDPRSVTIPCSIGEVVVGKALIDLGASINLRPLSMCQRLREIEIMPTCMTLQLADRSITRPYGVIEDVLVKVNVMEEKRLEKKVLEVGTLLDPG

SEQ ID NO: 232861 - protein, 39 aa, Glycine max
  Coding DNA Sequence Number=SeqID_116083
MTVISVALVSLALDMKGFSEILRDKKDCERLNVITEPLH

SEQ ID NO: 232862 - protein, 152 aa, Glycine max
  Coding DNA Sequence Number=SeqID_116084
  Subcellular localization annotation: CTP_CleavageSite=38; ConfidenceScore=5.10e-01
SKSLAFVDHTAFCRHDSRAGSPRRHLTVIRTSSFSDPKCDSRAETNMVICALSGDVSIFRWRLSKSHKLSRTTSCDVHPLSSRGGGPDDKQRPKTKFGHSAPMIRGDTLWLFAPFCHPEAAGPMTSRDQVWSFCTLVSSRGGGPDDTRKYPS

SEQ ID NO: 232863 - protein, 440 aa, Glycine max
  Coding DNA Sequence Number=SeqID_116085
  Gene Ontology: Mol. function=mannosyl-oligosaccharide 1,2-alpha -mannosidase activity; Cellular component=membrane; Biological process=metabolic process
  Homolog annotation: Hit_ID=Q93Y37; Match level="QueryCoverage=99%, HitCoverage=68%, E-value=1e-162, Identity=68%"; Hit description =Endoplasmic reticulum alpha-mannosidase, putative
  Pfam annotation: Domain name=Glyco_hydro_47; Domain location=145-438; Score=104.5; E_value=3.2e-28; Accession=PF01532.11; Description =Glycosyl hydrolase family 47
  Subcellular localization annotation: CTP_CleavageSite=22; ConfidenceScore=5.33e-01
MSKSLPYSTKDVDYDNAKFRPRSFFKVATQNLLTSNLRRDCGSCSTGKFLFLILIFGVAYLMLAHTSSGGVVSDDEAIVNRNSYANSSIVNGAGKIKRFWRRPPRLPPRLSPDEKGSGNGNDHVSGNPDVVRSMWIARQKKVKEAFVHAWSGYKKFAMGYDELMPLSQHGIDGLGGLGATVVDALDTAMIMGLDEVVAEAGSWVEEHLSERISKKGQVNLFETTIRVLGGLLSAYHLSGGEKGTNLTHAGPKPAVYLETAKDLADRLLSAFTASPTAIPFSDVILHEKSAHPAPGGLSSTSEVSTLQLEFNYLSQISGDQKYSLEAMKVMEHMKTLPKIEGLVPIYISPHSGEFSGENIRLGSRGDSYYEYLIKVWLQSGASSNSNTSYLYEMYNEAMNGVRHLLVRKSIPNGLVFVGELPYGSNSNFSPKMDHLVCSTF

SEQ ID NO: 232864 - protein, 768 aa, Glycine max
  Coding DNA Sequence Number=SeqID_116086
  Gene Ontology: Mol. function=voltage-gated potassium channel activity; Cellular component=integral to membrane; Biological process=potassium ion transport
  Homolog annotation: Hit_ID=Q93YI7; Match level="QueryCoverage=99%, HitCoverage=98%, E-value=0.0, Identity=60%"; Hit description=Inward rectifying potassium channel
  Pfam annotation: Domain name=Ion_trans; Domain location=94-275; Score= 82.9; E_value=1e-21; Accession=PF00520.21; Description=Ion transport protein
  Pfam annotation: Domain name=Ion_trans_2; Domain location=184-281; Score=50.2; E_value=6.8e-12; Accession=PF07885.6; Description=Ion channel
  Pfam annotation: Domain name=cNMP_binding; Domain location=386-475; Score=55.6; E_value=1.7e-13; Accession=PF00027.19; Description =Cyclic nucleotide-binding domain
  Pfam module annotation: Pfam domain module=Ion_trans::Ion_trans _2::cNMP_binding; Domain location=94-275::184-281::386-475
MSVSCVKNFFQRFWQDEFQTGNIPHGSFLANDDLLPSLGARINQETRLRRYIISPFHPRYRAWELVLVVLVIYSAWICPFEFAFLPYKENALFIADNIVNGFFAIDIVLTFFVAYLDRHSYLLVDDPKKIAISFLFNHSSELGFKVLNMFRLWRLRRVSSLFARLEKDIRFNYFWTRCTKLIAVTLFAVHCAGCFNYLIADRYPDSKRTWIGAVYPNFKEENLWDRYVTAIYWSIVTLTTTGYGDLHAENTREMLFDIAYMLFNLGLTSYIIGNMTNLVVHWTSRTRNFKILHNFPVSFMRDTVKAASEFASRNHLPHRIQDQMLSHICLRFKTEGLKQQETLNDLPKAIRSSIAHHLFFPVVQKVYLFQGVSHDFLFQLVSDMEAEYFPPKEDVMLQNESSTELYVLVSGAVDLVRYMDGHDHVHGKAVAVDAFGEIGVLYHIPQPFTVRTTELSQILRINKTSLMNVLHANPGDAQITMDNLLMRLKGLEGFGFEYPCTDSGRLTHEVLQGGNTRGNFSHECTNNSPEHSLMHEGECLDIRNSETSLRKVTNDDHLVPKHNVILEHVRRDPHAPAHKGNLDIVEILLGRDAHPNPNSIGWTQKARVKQPKNKSICDQKMSCENEKLDEYRIEIAEPEILDLDRNGSTRNTRQDGIRSIKFPLEKINTNSNSRNSNCPSDRESARLTKKRVTIHLLQSRSTSRGQHGKLIILPDSLQELLKIADDKFGGFNPIKVINTENAEIDDINVIRDGDHLFLLCSGDEDLSS

SEQ ID NO: 232865 - protein, 106 aa, Glycine max
  Coding DNA Sequence Number=SeqID_116087
MVVVAVIMLVVITVVMMMITVVTTITIILVMVAVDDHASDCNGNHDTCGGNDRDNGDSHSDHRKSESLKEPKQSSSFMDSWRLLPLPCQFLVFGIWVGLTQQPIAY

SEQ ID NO: 232866 - protein, 118 aa, Glycine max
  Coding DNA Sequence Number=SeqID_116088
DQRVPMNPKRIKVIPEWLTPPTPLIELVRNHVPSWEDAQEMGVEGRSPEYDEPRDLRSNPFQGGGNDAILSRKGIGNLLEEASQGGELSYERASSSSFLSKAILGGEAPSSLAYFLVD

SEQ ID NO: 232867 - protein, 162 aa, Glycine max
  Coding DNA Sequence Number=SeqID_116089
  Homolog annotation: Hit_ID=O04892; Match level="QueryCoverage=30%, HitCoverage=9%, E-value=2e-12, Identity=75%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGPLPRASNSQLRTGTDKGNPTV

SEQ ID NO: 232868 - protein, 201 aa, Glycine max
  Coding DNA Sequence Number=SeqID_116090
  Gene Ontology: Mol. function=tetracycline:hydrogen antiporter activity; Cellular component=integral to membrane; Biological process=tetracycline transport
  Homolog annotation: Hit_ID=Q9HWJ4; Match level="QueryCoverage=72%, HitCoverage=33%, E-value=5e-36, Identity=57%"; Hit description =Probable major facilitator superfamily (MFS) transporter
MGFGYAAWNVGILHGNVTVLAAASYFIPIISAVLAAVMLKSHLNIAFWQGTAMAVNPTTSGKDRSYHVKYHFCRRRGSFVDGYVLSIIGIAMMKVSPALGLSAFWEGLIAASALIGIFFGGFIGGALTDRLGRRVLYFVGPTLFVVCSLAQYWVQSGEVLFALRFMNGVAVGIEYPVATAFLVEFLPKKNRGPCLATLTIL

SEQ ID NO: 232869 - protein, 137 aa, Glycine max
  Coding DNA Sequence Number=SeqID_116091
MASTKRKSTASRSQTQYDTRQFQSLEAWNKYTDSILGRNILPERNVQLYHTEFDEFKVELERRNLHKCLTNLQEGSIDVAVVKEFYANLYSPKDQSPKQARLRGHLIKIDADNLNEFLETLVVLEEGETLPTLDSAG

SEQ ID NO: 232870 - protein, 104 aa, Glycine max
  Coding DNA Sequence Number=SeqID_116092
REFAKRNLQRLSARKNPEEDELSSSLSAPLQICAKHTSMNKATYLSLKSDLQREFDTFLEKLYMHEGEGDLLTTCVFAVFHLILLFVVKEVSELWKAKSSVGSS

SEQ ID NO: 232871 - protein, 114 aa, Glycine max
  Coding DNA Sequence Number=SeqID_116093
ILCKVEAQEESPVKEHESREKDEEQAQQQWEKYSTVENNQESILQINNLPHQWIDKKRRQGEHEETLSAILSLITNTFPEMNWNVLLNYMKFMEFLAKRRNCKEDVFYATFMPP

SEQ ID NO: 232872 - protein, 152 aa, Glycine max
  Coding DNA Sequence Number=SeqID_116094
MLAKRNLLPMASRKRRTSTSRPQEPYDTTRFVSEVTWKRYEQNVHSRNILLERNVDLYATQYDEFRKVLKRRRWHKALTRQPDNHIDVALVKEFYASLFDPEDKSPMQVKVRGKLIKFDAATLNKFLETPIVLEPGERYSTYSRFCHMHPDP

SEQ ID NO: 232873 - protein, 56 aa, Glycine max
  Coding DNA Sequence Number=SeqID_116095
MKRKAKGTYLDMARLADLMPHDAIVGLRLARCSRLALCHSREGFRLSEMTRLAQLP

SEQ ID NO: 232874 - protein, 175 aa, Glycine max
  Coding DNA Sequence Number=SeqID_116096
MVERDKFDHIEERLRAIEGGRVMDSARCGYSSKVQDEKLLMHFFQESLTGATVTWYTNMEPSRVYSWKDLMVAFIRQYQYNFDMAPDRMQLQIMCKREHRSFKEYTQRWRDLIAQVVPPMMEREMIIMIVDTLPVFYYEKIDVAPCEACRPWIFFINGVLCFLKFNGSRMKKEER

SEQ ID NO: 232875 - protein, 158 aa, Glycine max
  Coding DNA Sequence Number=SeqID_116097
  Subcellular localization annotation: CTP_CleavageSite=37; ConfidenceScore=5.11e-01
MKMNMNLGSLISGQISLIAQSNSSRLGFTALITALCKARGVTSDSLTFESLNLAINLAYIKKNCWNLDEPSVTFPGTQKSKARRSEAPSTSAASTPPTSAPSTSALPSPPAAPVLPEPASGPAPDHTEFAGCGPTAASYELGGVCSEDGLARSPAGIL

SEQ ID NO: 232876 - protein, 409 aa, Glycine max
  Coding DNA Sequence Number=SeqID_116098
  Gene Ontology: Mol. function=helicase activity; Biological process =viral genome replication
  Homolog annotation: Hit_ID=Q1SRJ5; Match level="QueryCoverage=99%, HitCoverage=61%, E-value=9e-78, Identity=48%"; Hit description =Probable helicase [imported]-Arabidopsis thaliana-related
MGSVLDFFLRSSTKQKLLTKMDFQYIGEEITDVCPQLLLKYRTHLNVKWCNQSTSIKYMFKYIYKGSYQITIDIVNVQNQNSRQNQVDDEIKHYLDCRYVSPPKACWKIFAFPMHGRAPTIERLYFHLQNQWPVYWTDSQQIRVVLSKSTIKESTFTAWMDSNKIYHHGRDLTYAEYVSKFIYVAHKRCWQPRKQGNTIGRLIWVPPSTRELFYMRMMLSSVKGSQSYKDIRTIDNVVYHTFREACFAKGFLVSDQEFVGALGEANTWGTPHFLRKLFVKLLFMNTMDRPEYVWEQTWQWMADDIVFNHRRQDEQVSIFNKIMCVVASQSGGVYFLYGYGGTGKTFMWKTLSSAIRFNGGIVLTVASSGIASLLLPGGRTSHSKFAIPVLTTQNSTCNIHQGSDLAELL

SEQ ID NO: 232877 - protein, 118 aa, Glycine max
  Coding DNA Sequence Number=SeqID_116099
MEAMKEQMITMMEAMMSMRKMKEVNMATVIAKSIATEVNSTHPFGLNQAKEEKVQAADDSLSEVDPLSEMNPLSEASSSLSGWETLEEDKPEMCSPSAQQARPAWMSSLLALSAPTLA

SEQ ID NO: 232878 - protein, 87 aa, Glycine max
  Coding DNA Sequence Number=SeqID_116100
MSHGPRRMKRKAIKKEDPRRRILLGMTMTHPMVRRRRSIFYPRTMKVMRTSLKKFKYEKQKADFHLQRSRHLSHEKVRKSVIDYQML

SEQ ID NO: 232879 - protein, 107 aa, Glycine max
  Coding DNA Sequence Number=SeqID_116101
MENESSEAIIPEPFDIGEEAKETQVRQVAATTPKRSLKATSEPSAPMVNLPSPQPAAEPSTPLLQMAEDPTTPVLAVDTSPPATPELQLKDEENGQTQDTQDQSQEF

SEQ ID NO: 232880 - protein, 170 aa, Glycine max
  Coding DNA Sequence Number=SeqID_116102
  Pfam annotation: Domain name=Lipase_GDSL; Domain location=2-146; Score=-19.9; E_value=0.076; Accession=PF00657.12; Description=GDSL -like LipaseAcylhydrolase
RSSTCVRGSGYLKPGLYGPTFGERIAALDPALTPDLVIIQGSINDRAQGADGYREAVTAAWDALTAKYPAAAIVVLGPAPHELPVGAETARIDADLAELAGARGWWYISPVTEQWITEQNYLDLIDVEAGRKHPSTEGHRYLAEKLAAALGELRVAPVTEAGGSESTPDE

SEQ ID NO: 232881 - protein, 100 aa, Glycine max
  Coding DNA Sequence Number=SeqID_116103
FYEVPITSNKGISPPTNRVFIKKYCVSRQAQGETPQQPGDGRQWAIDAPPSPLEFTSTHPQKGSKMPWTRMYVAKYLTKIYVCLGSKIPHEKERERARKE

SEQ ID NO: 232882 - protein, 113 aa, Glycine max
  Coding DNA Sequence Number=SeqID_116104
MQWFFQISHPFVTPTEDTGEPRPAPPPPTHDDDFVEPPVAEVPVASDPPTHYVVDCTACIRIGRIAEHLERVINLRMVTARTDLYDIMNLCLRIVRDVDPNDSPRPRQRPRID

SEQ ID NO: 232883 - protein, 153 aa, Glycine max
  Coding DNA Sequence Number=SeqID_116105
MDKVEAIVALIPNVRLNLLTCDVANYKRNTVLIKPDISEPYELLIALLQCTPYTKTNKPEQDPTFVNTEDQSYMMLSVPSSNRQNGCLVAFTQFHHTSNPNQVSLKCKKLYGCTKNRGADTIKFKEGHHKALLPQRLCIRKKGRKEDDLEADP

SEQ ID NO: 232884 - protein, 286 aa, Glycine max
  Coding DNA Sequence Number=SeqID_116106
  Pfam annotation: Domain name=AT_hook; Domain location=96-108; Score =14.9; E_value=0.061; Accession=PF02178.9; Description=AT hook motif
MYVFVVYPLPKVAFKPKCAGRNLNKVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSMISKLIWSTKFRALLSLSLHSSPSSSKLLSMASYGVASPLSLPFSIPLPFIFQEAKESIDEEDPRPTSSNGACINVSSQFIWLAWCMELRIDQIEMSRINQLFLMILVHFDFPLHTFCGYPPEIVNKMPKKELAEELLFVYAIRDNIIDPVKDEVLGPLNFSEK

SEQ ID NO: 232885 - protein, 103 aa, Glycine max
  Coding DNA Sequence Number=SeqID_116107
MTLEKAYCLAKDNKLSAGWEVKSTIGGVPIAKEKWAARSHTPSAHPRATCPGTITLSHTQRLSEIKQRGEEKRSALSHWESHKRKMHHALSRQHRAKRVPAAP

SEQ ID NO: 232886 - protein, 142 aa, Glycine max
  Coding DNA Sequence Number=SeqID_116108
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=P48631; Match level="QueryCoverage=82%, HitCoverage=33%, E-value=2e-54, Identity=78%"; Hit description=Omega- 6 fatty acid desaturase, endoplasmic reticulum isozyme 2
MAHSMNYNVLLKNKYGKSEDSTWRIVKVFRVPLDTGLLLWHKYFIPLKRTSVGVVMAMATRVEDKDNNIIKQLVVTECMVATLMGNDPNSSKDATLDSPVDWPCQERERAGKDVEVMGGNIIEAEGYGEVANESHFKLRVHI

SEQ ID NO: 232887 - protein, 120 aa, Glycine max
  Coding DNA Sequence Number=SeqID_116109
MVRSRMDKMQAICTTNKHSDEAWFLWKWRKLFGIQHNNLSSSDQSAVSGFAKKVLRIDFLLTAFFSGGSDTKIETEEGKESTQQQTCIWGKNGGRMLIVSGNQKLLRPREIAYLFMFIDG

SEQ ID NO: 232888 - protein, 121 aa, Glycine max
  Coding DNA Sequence Number=SeqID_116110
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=83%, HitCoverage=11%, E-value=2e-16, Identity=47%"; Hit description =Putative receptor-like protein kinase
  Pfam annotation: Domain name=LRR_1; Domain location=36-58; Score =15.3; E_value=0.22; Accession=PF00560.23; Description=Leucine Rich Repeat
  Pfam annotation: Domain name=LRR_1; Domain location=60-82; Score =16.9; E_value=0.073; Accession=PF00560.23; Description=Leucine Rich Repeat
  Pfam annotation: Domain name=LRR_1; Domain location=84-106; Score =19.3; E_value=0.014; Accession=PF00560.23; Description=Leucine Rich Repeat
  Pfam module annotation: Pfam domain module=LRR_1::LRR_1::LRR_1; Domain location=36-58::60-82::84-106
MPTTQNIAPRKVPPVAIIISHQNLGGDVSSISRLKALKWLDLSNNDFHGLIPPTFGNLFYLKYLDLSSNKFKGSIPPELGALRSLKTLNLSNNLLVGEIPKELQGLESLHDFQIFNNHLME

SEQ ID NO: 232889 - protein, 72 aa, Glycine max
  Coding DNA Sequence Number=SeqID_116111
MADSKLLIYEGLTTIHNVLLCSDQVKVDVEEVRDVDACVPIPTKEGLEGPLKPVDRLDLDVDPLYLMTLTIP

SEQ ID NO: 232890 - protein, 98 aa, Glycine max
  Coding DNA Sequence Number=SeqID_116112
MRPMPIAWSELEKWREEEVTFFCGNPRKNLLPLTLVEEVLPCSSTEEGSSAVLLPLTLTEEIFCGHPRKNFLLQLTKEGYSVDARGRFLPRVSMEEVC

SEQ ID NO: 232891 - protein, 64 aa, Glycine max
  Coding DNA Sequence Number=SeqID_116113
MDDGIKEEVLETSIVTERSDSNKDKEEGHDLDSTLANTMNGASSSVESPSKKRRTSEAGGVVLS

SEQ ID NO: 232892 - protein, 235 aa, Glycine max
  Coding DNA Sequence Number=SeqID_116114
  Gene Ontology: Mol. function=transcription factor activity; Cellular component=nucleus; Biological process=regulation of transcription, DNA-dependent
  Homolog annotation: Hit_ID=Q8L701; Match level="QueryCoverage=62%, HitCoverage=42%, E-value=1e-26, Identity=46%"; Hit description =Putative Ap2 domain protein
  Pfam annotation: Domain name=AP2; Domain location=106-172; Score =134.1; E_value=3.9e-37; Accession=PF00847.10; Description=AP2 domain
MECARKTITTKFMKSSKFFPKVVRISVTDQDATDSSSDEEAERVKVKKIVVNEIVCVNNNKKRHNNDNSGCCYSTKDNESLKQQRQQSLVSLGEEGYMDSKQSLKQHKFRGVRQRPWGRWAAEIRDPLRRTRVWLGTFDTAEEAAMVYDKAAIKFRGAEAVTNFIKPPLKDDAVSLEICESVVSGTSCACDSPTSVLVFQPWMEPPLLEETFKEVFSGLTDGYDDVMILHCNDEK

SEQ ID NO: 232893 - protein, 69 aa, Glycine max
  Coding DNA Sequence Number=SeqID_116115
MEKKTERRSRQREGDETYLGMVAKEKKQRLVTMLKCDEDDARVRRTQCSDADRDLEGRRRLEEEESAKA

SEQ ID NO: 232894 - protein, 66 aa, Glycine max
  Coding DNA Sequence Number=SeqID_116116
MLRMKPQRRRPTASARRQRKATPVVEDVQHVDHVADEGFSGGPHDTSILMDYVHHVAVTIWNGEPW

SEQ ID NO: 232895 - protein, 79 aa, Glycine max
  Coding DNA Sequence Number=SeqID_116117
  Gene Ontology: Mol. function=dolichyl-diphosphooligosaccharide -protein glycotransferase activity; Cellular component=endoplasmic reticulum membrane; Biological process=protein amino acid N-linked glycosylation via asparagine
  Homolog annotation: Hit_ID=Q9LVR2; Match level="QueryCoverage=62%, HitCoverage=11%, E-value=1e-12, Identity=68%"; Hit description =Dolichyl-di-phosphooligosaccharide-protein glycotransferase (Oligosaccharyltransferase)-like
  Subcellular localization annotation: CTP_CleavageSite=50; ConfidenceScore=5.13e-01
MYYAHLAMKNIHISFLMRLAHLAYMQQAPVLFQGSGHSLNPTNSLVLKVLSASPTTFFANPKSKVTTPPSLNGTSIIQA

SEQ ID NO: 232896 - protein, 40 aa, Glycine max
  Coding DNA Sequence Number=SeqID_116118
MWNFLTPLHRFLLEQAPTTAPQTCPATKREKAHFFSSLKK

SEQ ID NO: 232897 - protein, 105 aa, Glycine max
  Coding DNA Sequence Number=SeqID_116119
MPIYPCGGIAPTKTPSGPGEVQQGPWVSSSGYGLLLVLQGARSPQQGIAPARHPVDPKKSNRVLELPTLITGLCQFYGVPVAPSKVIRPPTNRAFIKKYCAPRQA

SEQ ID NO: 232898 - protein, 181 aa, Glycine max
  Coding DNA Sequence Number=SeqID_116120
  Homolog annotation: Hit_ID=Q2HRX8; Match level="QueryCoverage=30%, HitCoverage=7%, E-value=2e-07, Identity=48%"; Hit description=IMP dehydrogenase/GMP reductase
MCVSVDCDKEDSEEGIYSDVQAAPRSSADPRCLLDAICGAPTYAGLSSDFVLLGTAPLGAYCCQIQTGEGYASVGCVQCIPADPIHSWVSYDGVDDTWTHYSDHLAAASSALTHADPDADEPRHAVKACHAIAEALEQHLNALGTSTHEEVIQKCLRIVRGVTKDRNVYVRSRRRRCTDQQ

SEQ ID NO: 232899 - protein, 132 aa, Glycine max
  Coding DNA Sequence Number=SeqID_116121
  Gene Ontology: Mol. function=protein serine/threonine kinase activity; Cellular component=nucleus; Biological process=protein amino acid phosphorylation
  Homolog annotation: Hit_ID=Q8SA64; Match level="QueryCoverage=79%, HitCoverage=16%, E-value=3e-49, Identity=88%"; Hit description=NIMA -related protein kinase
MEQYEILEQIGKGAFGSALLVRHKHEKKKLRYVLKKIRLARQTDRTRRSAHQEMELISKVRNPFIVEYKDSWVEKGCFVCIIIGYCEAGDMAEAIKKANGVNFPEEVDHSCSNSFSHMSLTVFHSYFRALWN

SEQ ID NO: 232900 - protein, 295 aa, Glycine max
  Coding DNA Sequence Number=SeqID_116122
  Gene Ontology: Mol. function=protein serine/threonine kinase activity; Biological process=protein amino acid phosphorylation
  Homolog annotation: Hit_ID=Q1SMH9; Match level="QueryCoverage=98%, HitCoverage=48%, E-value=1e-67, Identity=53%"; Hit description =Protein kinase
MATINFMTLNPSISGTEQISQCSTERADGLSTCSEEKIYELSVGCVRGKYKTDKSKATKFSTVERTPRSRGVTVSATTKRQTMATSKTTHSGPSDSLPASHAPSGKFSTPPRARARATPNLYTNVLGSVDSLDVSINAPRIDKIAEFPMTFCEDPFSPIRGPSSTSARCSSSSAGSTADCSITKDKCTIQEDKVILPTSITNACPGPKGTECSPEHVKACVSSHSSADLDQHWFDTSSYQQRAEALEGLLEFSARLLQQERFDELGVLLKPFGPEKVSPRETAIWLTKSFKQTAV

SEQ ID NO: 232901 - protein, 376 aa, Glycine max
  Coding DNA Sequence Number=SeqID_116123
MSIDSSKNFIYFAFLGTPTKTHEKLQQKSYLTRAKAPEKAKEIDADVQKQWQEADYQLEDLINCLLPVPPIRDITQVWFSTSSTCKIQIPGIRGSTVRSIFWGEGNYNTLVEEKNGEFHGILEGGNQRFQLKATKPEPSSGHSRVLCSEESWKQVAEEAKNLENEHVNGQRNSMQHVTKWVEENSNGKECLAVAIKLRILKRLVSPPPSPEPPNSKHTIALEEDTSVKEELRVVEAISENSDDEGTTLEELYAEDAPHKYLMGVKVTVIKEKLVVEDYPNQRPPKPKGTNWIFVSECNIRFHATLAWRASPSSMQGQTLLRPATTHLAPTKNSDKGVLIDSQSGFQLIVKSIGSLLTKNANWDEKQALLGCIERME

SEQ ID NO: 232902 - protein, 370 aa, Glycine max
  Coding DNA Sequence Number=SeqID_116124
  Gene Ontology: Mol. function=sequence-specific DNA binding; Cellular component=nucleus; Biological process=regulation of transcription, DNA-dependent
  Homolog annotation: Hit_ID=Q338B0; Match level="QueryCoverage=59%, HitCoverage=60%, E-value=2e-71, Identity=60%"; Hit description=HSF -type DNA-binding domain containing protein, expressed
  Pfam annotation: Domain name=HSF_DNA-bind; Domain location=47-219; Score=251.3; E_value=2.1e-72; Accession=PF00447.8; Description=HSF -type DNA-binding
MNYLYPVKEEYLESPPPSSSSPTTGVDESAMVPPPRPMEGLHEIGPPPFLTKTYDAVEDPTTSHIVSWNRGGASFVVWDPHAFSRDLLPRYFKHNNFSSFVRQLNTYGFRKIDPDRWEFANEGFLRGHRHQLASIRRRKQPSRPYSSSSSSQQAQGHCVEVGRFGLDEEVDRLRRDKHVLMMELVRLRQQQLNTRSYLQAMEERLRGTEIKQQQMMAFLARALKNPTFIQQLLQQKEKRKELEEAMSKKRRRPIEGGPSGVGEPSSGGEEGRSSVKVEPLVLGEYGFGVSELEVLAMEMQGYGRGRREQEEEPEALESQERLEKELDEGFWEELFSEGFEGELDIPTSQDQDEDVSVLANRFGYLGSSPK

SEQ ID NO: 232903 - protein, 209 aa, Glycine max
  Coding DNA Sequence Number=SeqID_116125
  Gene Ontology: Mol. function=protein binding; Cellular component =thylakoid; Biological process=ethylene mediated signaling pathway
  Homolog annotation: Hit_ID=Q0QW06; Match level="QueryCoverage=84%, HitCoverage=57%, E-value=1e-84, Identity=62%"; Hit description =Ethylene-overproducer1-like protein
  Pfam annotation: Domain name=TPR_1; Domain location=128-161; Score =7.2; E_value=0.74; Accession=PF00515.18; Description=Tetratricopeptid e repeat
  Pfam annotation: Domain name=TPR_1; Domain location=163-194; Score =4.1; E_value=1.7; Accession=PF00515.18; Description=Tetratricopeptide repeat
  Pfam annotation: Domain name=TPR_1; Domain location=32-65; Score =24.4; E_value=0.00041; Accession=PF00515.18; Description =Tetratricopeptide repeat
  Pfam annotation: Domain name=TPR_2; Domain location=128-160; Score =6.5; E_value=5.7; Accession=PF07719.7; Description=Tetratricopeptide repeat
  Pfam annotation: Domain name=TPR_2; Domain location=161-194; Score =15.7; E_value=0.17; Accession=PF07719.7; Description=Tetratricopeptid e repeat
  Pfam annotation: Domain name=TPR_2; Domain location=32-65; Score =15.1; E_value=0.25; Accession=PF07719.7; Description=Tetratricopeptid e repeat
  Pfam module annotation: Pfam domain module=TPR_1::TPR_1::TPR_1::TPR _2::TPR_2::TPR_2; Domain location=128-161::163-194::32-65::128 -160::161-194::32-65
MEVTGGYSSNREQRDDMLELSETLFTFTLPSEVALNNLGSVYVDCGKLDLAADCYINALKIRHTRAHHGLARVHCLKNDKAAAYMEMTELIKKAKNNASAYEKRSEYCDREQAKADLEMVTRLDPLRAYPYRYRAAVLMDNHKEEEAIAELSRAIAFKADLHLLHLRAAFHEHKEDVLGALRDCRAALSVDPNHQEMLELHSRVNRHEP

SEQ ID NO: 232904 - protein, 1102 aa, Glycine max
  Coding DNA Sequence Number=SeqID_116126
  Gene Ontology: Mol. function=binding; Cellular component=thylakoid; Biological process=ethylene mediated signaling pathway
  Homolog annotation: Hit_ID=Q1SMH2; Match level="QueryCoverage=64%, HitCoverage=98%, E-value=0.0, Identity=68%"; Hit description=BTB/POZ
  Pfam annotation: Domain name=BTB; Domain location=553-660; Score= -7.6; E_value=0.02; Accession=PF00651.21; Description=BTBPOZ domain
  Pfam annotation: Domain name=DUF828; Domain location=3-177; Score =68.4; E_value=2.2e-17; Accession=PF05703.2; Description=Plant protein of unknown function (DUF828)
  Pfam annotation: Domain name=PH_2; Domain location=224-297; Score =4.6; E_value=0.00035; Accession=PF08458.1; Description=Plant pleckstrin homology-like region
  Pfam annotation: Domain name=TPR_2; Domain location=1016-1049; Score =14.9; E_value=0.29; Accession=PF07719.7; Description=Tetratricopeptid e repeat
  Pfam annotation: Domain name=TPR_2; Domain location=761-794; Score =2.5; E_value=17; Accession=PF07719.7; Description=Tetratricopeptide repeat
  Pfam annotation: Domain name=TPR_2; Domain location=982-1015; Score =3.5; E_value=13; Accession=PF07719.7; Description=Tetratricopeptide repeat
  Pfam module annotation: Pfam domain module=BTB::DUF828::PH_2::TPR _2::TPR_2::TPR_2; Domain location=553-660::3-177::224-297::1016 -1049::761-794::982-1015
MWMQFFRANNSIHPLFNGGRASATIGNGTACSGPKTVGRWLKDRREKKKEENRTHNAQLHATISVAAVAAAVAAIAAATAGSSAPSKDEKMAKTDTAVASAATLVAAQCVEAAEAMGAERDHLASVVSSAVNVRSHDDITTLTAAAATALRGAATLKARALKEVWNIATVTPLERGIGGIGLCGKSINSNTSNTSNTSTSDSGEIFKGENFPGSCSQDLLAKGSELLKRTRKDVVLDICADLPAWPGRHLLDDGEKRRYFGLKTDARGIVDNEEDNVKSKASGGGNEEKSDGANEDDDGGDGDGEEQLNGEDGVDLANEGPTELRVLKHGGVEWPGIGIAIPTAFNISFHQHVFFLSSVLSLLKGCGAVVEIRDLFRLLCPMRSFFPAESCKEAHPNALNPQSWLHIERGKLPKLSSHPSSASIESLIKVPQPAILPFFKPVDYVEVLARIHEELESCPPQERSNLFLLQYQVFRGLGEVKLMRRSLQGAWQRAHTVHEKIIFGAWLKYEKQEEELMADLLAACGKCAKEFAPVDIAFHLPFDVNASSEGRTTNENRISQNVTFTIGSEKIVCDRQKISELSAPFHAMLKGHFSESLSETIDLSENNISPSGMKAISDFSLNGSLIEVPPNLLLEILVFANKYCCERLKDACDRRLASLVSSKEDAVELMEYALDEHSSVLAASCLQVLLRDLPNCMNDNRVVEIFVHANKQQLEVMVGPGIFALFCFLSEVSMNLNSSSDTTAHFLERLVEFAENGKQRLLALHQLGCVRLLRKEYDEARCLFEGAVNAGHMYSVAGLARLDYIKGDKLLSYGQLSSVISSVTSLGWMYQERSLYCDGDKRWEDLEKASNLDPTLIYPYMYRAATLMRTQNAHAALAEINRILGFKLSLECLEIRFFIHLSLEDYKAALCDVQTILTLRSDYRMFEGRVAASQLCTLVREHVERWTTADCWARLYDCWSAVDDIGSLSVIYQMLESDAAKGILYFRQSLLLLRLNCPEAAMRSLLLARQHASSEHERLVYEGWILYDTGHYEEGLQKAEESIDIKRSFEAFFLKAYALADSSIDPSCSPTVISLLEDALKCPSDNLRKGQERSLQGFPLRK

SEQ ID NO: 232905 - protein, 149 aa, Glycine max
  Coding DNA Sequence Number=SeqID_116127
  Gene Ontology: Mol. function=receptor activity; Cellular component =integral to membrane
  Homolog annotation: Hit_ID=Q94GN3; Match level="QueryCoverage=74%, HitCoverage=48%, E-value=3e-37, Identity=64%"; Hit description =Putative receptor-associated protein
MLMKRDVESGGDGNANPRPLYPAMLENPQLRWAFIRKVYTILTIQLLLTIAVASVVVFVRPIALFFVSSPGGLALYIVLLIAPLITVCPLYYYHQKHPLNYILLFIFTVTLAFAVGLTCAFTSGNIYLVNILSSFIAYEEEDVRQAVCS

SEQ ID NO: 232906 - protein, 84 aa, Glycine max
  Coding DNA Sequence Number=SeqID_116128
  Homolog annotation: Hit_ID=Q1RVT5; Match level="QueryCoverage=84%, HitCoverage=15%, E-value=4e-07, Identity=45%"; Hit description=AMP -dependent synthetase and ligase
MMMSLSAIINTTNPLNTTHEIAKQIINSNPLLALAIPPKSPQLAPLYQSFSWTMTTTPTPILSPRFEEMAKKEPGARHADDDGY

SEQ ID NO: 232907 - protein, 143 aa, Glycine max
  Coding DNA Sequence Number=SeqID_116129
  Subcellular localization annotation: CTP_CleavageSite=33; ConfidenceScore=5.04e-01
TLNHFTSASLKKLPSMIYSWQWDFYATSNHTFSFMMIFSFSRFFFTHHVDPIIEEVDLDTDAMFGSMDHALVEKKAHKWSLIGDFFYKKANGWKPPHSPTSPGSPLTISFDNLAGKHQSMKKVESKGELLCLKEAQSKGELLW

SEQ ID NO: 232908 - protein, 66 aa, Glycine max
  Coding DNA Sequence Number=SeqID_116130
MELQMHAYMQHLADQQAANHRGQMQWNDSSYQYTLHQHRQDRNPYLWPTPEQIRATIAWPRDRPNF

SEQ ID NO: 232909 - protein, 109 aa, Glycine max
  Coding DNA Sequence Number=SeqID_116131
MVDFMLYGKQHLESSDKKGLVSFLRIANLMYMCRLIHSFLINIVMPRLGSRDYLQAFKDRFHAKNKNNYIPYGILLTQIMRNSEPEGSNRLPVARIVFQTDLQSCNRLP

SEQ ID NO: 232910 - protein, 110 aa, Glycine max
  Coding DNA Sequence Number=SeqID_116132
MERSMIDAGSGGVLGDMTPAEARNLIEKMASNSQQFSARSDAIVIRGVHEVAMNSSPSAETKKLEDLCPSVQQSEAIEQPEAYAVNIYNRPPQPQQQNQPQQNNYDLSNN

SEQ ID NO: 232911 - protein, 112 aa, Glycine max
  Coding DNA Sequence Number=SeqID_116133
  Gene Ontology: Mol. function=transition metal ion binding; Biological process=cytoskeleton organization and biogenesis
MLKNWVLKKHNKTFLDWFKDTIFTDENAFETLRKLADEPKRNVITWQGYNINKYSFYTKAQDKKSIMQNSGVTLRAESQHFVHDDNPHVASIPYFGFIEEICDAILPPKGIG

SEQ ID NO: 232912 - protein, 93 aa, Glycine max
  Coding DNA Sequence Number=SeqID_116134
MPQQQVPSLYEHTTKLEETLAQFMQVSMSNQKSTESAIKNLEADEGKAEKKVEEHKQHLVAELTLEPISDFVELEEVVEDEDDQHERETPIKE

SEQ ID NO: 232913 - protein, 79 aa, Glycine max
  Coding DNA Sequence Number=SeqID_116135
MAGADSLDQQTEVFMKAMLKTGVDVLAVLWGQVGERTRHRQEVEWDRSVMPKGPHGAVQVRSPHTSFPMANPRGRQNGL

SEQ ID NO: 232914 - protein, 52 aa, Glycine max
  Coding DNA Sequence Number=SeqID_116136
VVYKSKGETKDIELVEEEQAQIGADSSSETSNKSENYKEEARNATQKHKPRG

SEQ ID NO: 232915 - protein, 219 aa, Glycine max
  Coding DNA Sequence Number=SeqID_116137
  Homolog annotation: Hit_ID=P75970; Match level="QueryCoverage=36%, HitCoverage=97%, E-value=2e-25, Identity=72%"; Hit description =Excisionase-like protein from lambdoid prophage 14
  Pfam annotation: Domain name=Exc; Domain location=113-196; Score =41.0; E_value=4e-09; Accession=PF07825.2; Description=Excisionase -like protein
MAKTNAERKAAQRERQRLAGIVPVEIKLDQQEAEMLRENCAARRPQREPYDLDEYITMLIRKDNAELKKQLAARNKRCCGKCKDKLPGDPAGCYFLGDSECWQTYGWHETKLTMLTLEEWAAERYRSKPPSLNTLRRCAKEGHFAPPARKEGKLWRVREDAELVGPLTTPVIKHNDNPKLRRILNDGSQTTRKANKVYWRYRHPVTGKYHALGDNERKL

SEQ ID NO: 232916 - protein, 132 aa, Glycine max
  Coding DNA Sequence Number=SeqID_116138
  Gene Ontology: Mol. function=unspecific monooxygenase activity
  Homolog annotation: Hit_ID=O04892; Match level="QueryCoverage=52%, HitCoverage=18%, E-value=6e-14, Identity=47%"; Hit description =Cytochrome P450 like_TBP
LPTLETAQPEVGSSGWKSTRTSRGVRCPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 232917 - protein, 57 aa, Glycine max
  Coding DNA Sequence Number=SeqID_116139
NPQLYNKDAEILTTVCYFRYMLYIQGEVVIKHPKHGSIPHNLQQLQKKLWDGQCHQI

SEQ ID NO: 232918 - protein, 193 aa, Glycine max
  Coding DNA Sequence Number=SeqID_116140
MVIPKFKVPNFDKYKGTTCPDNHLKMYCRKMGAYAKDGKPLIHFFQESLTGAAVTWYTNLEPSRVPFLEGPNGCLRWAVSGSGSPKWHPPMMEREMIIMMVDTLPVFYYEKMVGYTPSSFADLVFAGERIEVGLKIGKSDHPALINEKTGANKEDEKEGETYVVTAIPIGPSFPPTQQCHYSANNNPSPYPPA

SEQ ID NO: 232919 - protein, 69 aa, Glycine max
  Coding DNA Sequence Number=SeqID_116141
MDLFSINQYKIDSLIVGSAKYVIRQGKGWLAIDNLKGSESCARGFQDHGIALGRRQGNEKSKETSSHTA

SEQ ID NO: 232920 - protein, 182 aa, Glycine max
  Coding DNA Sequence Number=SeqID_116142
MYGVLTLILLSGAVHLFLKSHKNWGYGRVSTFKYKDFAARLINILLLGFCGVFCSFAYDIMIVSNDAPGKTQFEVSTYICKAGGLMLAYIALSKSLNPDLTKADLRRLLKSEKSAADTNPANSRQNYTQHKFLPDICACFRCSAAGAAHKVWRLVNNAPKVFSLTTSVCSLMSFRILLRFQT

SEQ ID NO: 232921 - protein, 107 aa, Glycine max
  Coding DNA Sequence Number=SeqID_116143
  Subcellular localization annotation: CTP_CleavageSite=29; ConfidenceScore=5.39e-01
MHTRSFTNPQFLRIGLTHKKVPSGVANCRNMPFAGERGRGSRVRFPKEERCAESPPTFICGKRRKNRRIPVKMKILSLGVVFTLEEGRQKRGFSSYVPSFGEEIRPT

SEQ ID NO: 232922 - protein, 94 aa, Glycine max
  Coding DNA Sequence Number=SeqID_116144
MFAGMKVLVTNTSTPYHRGGMMNASGHVYAMRDKCVYLRTQELGRPSLLTNNALGIMVHLQSLPWCPMHAIKKVKHTFRIPMTKMTKTNARHEQ

SEQ ID NO: 232923 - protein, 163 aa, Glycine max
  Coding DNA Sequence Number=SeqID_116145
MLNIQNLICGYEKISSADSPSPVDTLFFVRKAYVDLISWKFYLFTKARSHFSEENIETISSLTSYPELRRSEFLIGGYVGAGASLLSTAPLFVTMTQKLVARGDTLRSSSPRHSVTPSVIDERRPMWSSAPFPEVVSIFLVETFSSLTSYLELRRSEFLIEDT

SEQ ID NO: 232924 - protein, 86 aa, Glycine max
  Coding DNA Sequence Number=SeqID_116146
MGAKYLEVVKQGSHPNNGWSLDEIRMQNDHNLSLRVIGHDRAWAARHRMTIICLCMPPNTITSGWRKGLRNDHNLSPPNSRLTVPE

SEQ ID NO: 232925 - protein, 61 aa, Glycine max
  Coding DNA Sequence Number=SeqID_116147
NRVDDHGDDKEGGIGVVGASDGPWRRWPATAVVEDGDMKVWRLGKKRHIERSLVAQCDWFT

SEQ ID NO: 232926 - protein, 83 aa, Glycine max
  Coding DNA Sequence Number=SeqID_116148
AQGDAPQAADAPPPPHQADPAGSFGMERYLQHLVCQQAANHRAHVQTHDCLYQLSLSLQSQGFAPFSCPTPDQFRAEVAWPGD

SEQ ID NO: 232927 - protein, 124 aa, Glycine max
  Coding DNA Sequence Number=SeqID_116149
MSMYTKLLKDLLTRKGKYINNGSIVVEGNCSAMIQRIFPPKFKDPESVTIPCLVRAVFVGKTHIDLGLSQHALLRACEARLTGALSKGGKMRGVATNIYLWKTSEKPNETGQNKNSKFGSCIYV

SEQ ID NO: 232928 - protein, 71 aa, Glycine max
  Coding DNA Sequence Number=SeqID_116150
MFPATYILLMCLLSSFSPTINALLNLTLPHQRPHLESVVHDLQRKVNASLWRREMLSTPFLTPSAIFQYFL

SEQ ID NO: 232929 - protein, 207 aa, Glycine max
  Coding DNA Sequence Number=SeqID_116151
  Gene Ontology: Mol. function=RNA-directed DNA polymerase activity; Cellular component=chromatin; Biological process=RNA-dependent DNA replication
  Homolog annotation: Hit_ID=Q1SAV4; Match level="QueryCoverage=32%, HitCoverage=17%, E-value=2e-15, Identity=60%"; Hit description =Integrase, catalytic region
MTTQSNIVRVNQTGLQTHCRESLKLPMAPVSFFAFRQAIQTDPSTHLDCSIAQDLILQKGRVWLPNGLHFIRTLLEEFHTTPTGLLCPLSVPSAPWEDLSLDFIMGLPTYQGQTTILVVVGRFCKGIHLGMLHPHYTAYTVALLFMDIVGTSKIDAVGDRLTNKEALLTSLRRKLLKAHEVMKLNVDIHRQEVSFKTGDWVMVKLHP

SEQ ID NO: 232930 - protein, 164 aa, Glycine max
  Coding DNA Sequence Number=SeqID_116152
  Gene Ontology: Mol. function=racemase and epimerase activity, acting on amino acids and derivatives; Biological process=amino acid metabolic process
  Homolog annotation: Hit_ID=UPI00005F8E58; Match level="QueryCoverage =85%, HitCoverage=60%, E-value=2e-43, Identity=58%"; Hit description =COG1794: Aspartate racemase
  Pfam annotation: Domain name=Asp_Glu_race; Domain location=1-144; Score=11.5; E_value=1.5e-05; Accession=PF01177.12; Description =AspGluHydantoin racemase
MHKVADQITTATRIPLLHIADATAQRIRQAGVKRVGLLATAFTMEQEFYKGRLEQQYDIEVLVPDAPGRKTVHDIIYQELCLGVIRDESRAQYRDIIAQLVAQGAEAIILGCTEITLLVKAEDAAVPLFDTTLIHAQDAAQRRPAWSHRDVPELAASTGSLFCG

SEQ ID NO: 232931 - protein, 192 aa, Glycine max
  Coding DNA Sequence Number=SeqID_116153
  Gene Ontology: Mol. function=D-serine ammonia-lyase activity
  Homolog annotation: Hit_ID=Q82I77; Match level="QueryCoverage=91%, HitCoverage=41%, E-value=2e-40, Identity=44%"; Hit description =Putative D-amino acid deaminase
MMIATAALLAEHQLFASGEIILSAGGGAWFDVAAACFSAAQLPLPVTPLIRSGAYMAHDSGLYARIAPFAQPGATHHFSAALEIWGRVLSRPEPGLAFVDFGRRDVPFDQDLPNPLWIRQADGSAPRAATHLRITDVNDQHAYLQLPADDPLQPGDWIGCGISHPCTAFDKWRYLPLVDDDYCVTDSLETAF

SEQ ID NO: 232932 - protein, 119 aa, Glycine max
  Coding DNA Sequence Number=SeqID_116154
MGIRGCINYNFVIAIRQLGYPMRGAPSVESLTPFVTRGFSDPNARMLQGVHKAWEKVQRKDRELRGSGNGIIGDYRKWLRANTQGLDWLLKLRAAKEEEAEAPEESEEVQALKVELEKA

SEQ ID NO: 232933 - protein, 168 aa, Glycine max
  Coding DNA Sequence Number=SeqID_116155
MAKISFVHLFLVIAAIQHWPHQLNIKMPSCMVHAILSPPLGRILESLQIKPEDEGLKSLQDVQAVRWKFQGKKVVSAKWVFRNKLDETVKVVRNMTKLVVKEQPPGFESNTFPYHDYRSNKPAIHQTKYVKELLKKFKLEDAKEMKNPTHPTTSLGLDEESNKVENSQ

SEQ ID NO: 232934 - protein, 37 aa, Glycine max
  Coding DNA Sequence Number=SeqID_116156
MATSDPWKLSVEAMSSPKKAGAHLGVIDGMWVVCLGF

SEQ ID NO: 232935 - protein, 297 aa, Glycine max
  Coding DNA Sequence Number=SeqID_116157
  Gene Ontology: Mol. function=ATPase activity, coupled to transmembrane movement of substances; Cellular component=integral to membrane; Biological process=transport
  Homolog annotation: Hit_ID=Q9CAB3; Match level="QueryCoverage=70%, HitCoverage=32%, E-value=1e-78, Identity=69%"; Hit description =Putative ABC transporter; 82503-78258
  Pfam annotation: Domain name=ABC_tran; Domain location=80-267; Score =201.3; E_value=2.2e-57; Accession=PF00005.17; Description=ABC transporter
  Pfam annotation: Domain name=SMC_N; Domain location=45-270; Score= -128.3; E_value=0.032; Accession=PF02463.9; Description=RecFRecNSMC N terminal domain
  Pfam module annotation: Pfam domain module=ABC_tran::SMC_N; Domain location=80-267::45-270
MCHRERQSMNVLIHRNRIDRNRTGVGWNCTTEVVWNHTTGVCWSRAAKISWNRTGVNQNCTGVCGSHERDQRALNIILTGHLYLAKVGLSGSGKSTLLNLLLRLYEPSSGQIYIDGFPLNELDIRWLREHIGYVAQEPHLFHMDIKSNIKYGCPTNIKQADIERAAKKANAHDFISSLPNGYETLVDDNALSGGQKQRIAIARAILRDPVIMILDEATSALDSESEHYIKEVLYALKDESKTRTIIIIAHRLSTIKAADKIFVMDDGRIIEMGDHEELMRNDGLYAKLTKIQADILT

SEQ ID NO: 232936 - protein, 238 aa, Glycine max
  Coding DNA Sequence Number=SeqID_116158
  Homolog annotation: Hit_ID=Q1S7C5; Match level="QueryCoverage=72%, HitCoverage=22%, E-value=2e-07, Identity=44%"; Hit description =Integrase, catalytic region
MWQKQDLCLFGFNPCFRARCLLEFLDRLIRISYHREHMDSILEGLPRDFDSIIAFIESHLPHITTEEAEGFILPQELRLRKYNKLDSSSNSFAPTVNLTQASSSHSTENDSLNSYSDTNVVYTNQYSSDSRGTGGRNGHGERGFQLWWWPWWSKLRPPQVIVANSDSTASFTWFPDSGASFHVTNNSQNIQQNSPFEVQTRSSLVMDKVLRKVQRTAVRVENSEEFLKLIRKMKFATL

SEQ ID NO: 232937 - protein, 248 aa, Glycine max
  Coding DNA Sequence Number=SeqID_116159
  Pfam annotation: Domain name=RRM_1; Domain location=79-141; Score =12.4; E_value=0.01; Accession=PF00076.12; Description=RNA recognition motif. (a.k.a. RRM, R
MRESEREPERAIAPARDEDQEWTTVRRGRGKQRVGVRSREDPETHYTSERHGQTRRYQKANWREKANVTTFYFTRFLDYITEKDLWVQFKRWGDVREVFIPNHRNKDGRRYGFVRFTGVADERKLERQLDNIVLGGLKLYVNIPRYGRRNKRIEEQIDKNGITQEGHSITENKGRLAGTRYRNPSMTYAKVLSANNCDAELRRKYQHPHPRAMESHSSIHLDVSQGEKEKYTDTWVGRLKNLGSFEDN

SEQ ID NO: 232938 - protein, 72 aa, Glycine max
  Coding DNA Sequence Number=SeqID_116160
MEMGGIELAMGQHRREKIYKWYQKCQTVRYRTANGQMARTGCSCATPYAKEWYKERKMQDTCAKEWYKERKM

SEQ ID NO: 232939 - protein, 255 aa, Glycine max
  Coding DNA Sequence Number=SeqID_116161
  Homolog annotation: Hit_ID=Q8RY46; Match level="QueryCoverage=38%, HitCoverage=14%, E-value=3e-22, Identity=55%"; Hit description =Transporter associated with antigen processing-like protein
  Subcellular localization annotation: CTP_CleavageSite=57; ConfidenceScore=5.63e-01
MMSPDPNFLHSTLGLSQIPRWNIFFPCNSTKSQTHHFSSLTHSGRSEIFRVSGPETRSQVGFPFAKRVGSSTSILPSGSWWALPELREDGAEPTAAMLALRRMWELVADERLVAFVAAGSLVIAALSEITMPSILAASIFSAQSGETVAFSRNALFLLVLCLTSGICSDILEILGKLKQPERRKRKALGIGTANPSLRNGQPNEITLYSIFPPPLHHYSVILLCSTPIRLGFPISTFFQLSILIILLTIPCLDHD

SEQ ID NO: 232940 - protein, 283 aa, Glycine max
  Coding DNA Sequence Number=SeqID_116162
  Homolog annotation: Hit_ID=Q9CAB3; Match level="QueryCoverage=15%, HitCoverage=6%, E-value=1e-07, Identity=67%"; Hit description =Putative ABC transporter; 82503-78258
MALSWPLALSALVICSILSAIFLVYGHGGHGGGGGGIGGGDIGGSGNTYSGGSDNVVVAVNSDDVGDCGGDVGGSNVGGVGGDGGGSDSGGRGVGDGSKCDSGDNDGGSEIDGGGCGSNSGGDGDAVEVVVMSVAVVIAVLVVTASYAGDNDGDGGNDGGGIGDGGSGDGGGGGSGDDSKKMSLSNFGNMYQRKAAKLIQDFTACANDVAQETLSSIRIVRAYGTGKKEFGRCFILFLLTSVPALHGQQKQNSGPCFKTAKEKRSELHESHTDSIAIAIKDLP

SEQ ID NO: 232941 - protein, 139 aa, Glycine max
  Coding DNA Sequence Number=SeqID_116163
MVRSLDWGSAKQQQNRTKQQQNRVAEGRGGGWHSSRTVGHTGKGVHSCLDTGMGRAENSVTFFSPCTTPLHTCLAFFSPCTTPLHMVWHMSSQFWPLSPPLNLSQLDVLHDGLGKVSGVLHDFNELLPLANIPVEELEW

SEQ ID NO: 232942 - protein, 180 aa, Glycine max
  Coding DNA Sequence Number=SeqID_116164
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=29%, E-value=1e-19, Identity=37%"; Hit description=Chromo
MTRENSFKTWIAFTRALETEFGPSPYECPRSQLFKLAQIGSVQSYYVQFTALANQVLVGNGNALTAEGLIQDLEVKIQGHTLKLPVYLLPVSGADLVLGAAWLATIVPHLSDYNIPDDMEPELAMILYTYRTVLDVPSGLPPSRTHNHSIPLVEGAGPVKVKPYRYPHSRKDQIEVINDS

SEQ ID NO: 232943 - protein, 102 aa, Glycine max
  Coding DNA Sequence Number=SeqID_116165
MGLISGNQFGPLGNNGNSNRIGTSEISHDSYQENILESIKIEIELQYELSVAESDYNSVKINKITTFDNIQQIIDGLNKTGIIGEDPVGSSGLRIIKKGGLN

SEQ ID NO: 232944 - protein, 75 aa, Glycine max
  Coding DNA Sequence Number=SeqID_116166
MARFGTMLRMILEERLKPQLVLFCEVKGVTDLDVSSIGACRPRIFFINGFICFLEDEWQRNGEGRERGDATSRRI

SEQ ID NO: 232945 - protein, 136 aa, Glycine max
  Coding DNA Sequence Number=SeqID_116167
MPPTVPVNQYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 232946 - protein, 56 aa, Glycine max
  Coding DNA Sequence Number=SeqID_116168
MEQFRWGGTYLSMETMRLLNKSDGSRSHIGVTTPHDNVGALDYQFLFQHSSHTFVG

SEQ ID NO: 232947 - protein, 45 aa, Glycine max
  Coding DNA Sequence Number=SeqID_116169
MEEKNEGYNHYSTDGGGVTGVAGAETGCGLASTDVGSVTGVAGSL

SEQ ID NO: 232948 - protein, 72 aa, Glycine max
  Coding DNA Sequence Number=SeqID_116170
MHVKQHQKDMQLEYDVLARRRRQSREKDAAKYLGTVTGCHGGDMSRSQAVTVVVEGDRVAKMKLRRRRRDRE

SEQ ID NO: 232949 - protein, 56 aa, Glycine max
  Coding DNA Sequence Number=SeqID_116171
MNFAFRKGGGTRDEDRENPAQGVKQHRMASNVDSLPSISNNNIRVRYVSKRGEEWA

SEQ ID NO: 232950 - protein, 105 aa, Glycine max
  Coding DNA Sequence Number=SeqID_116172
  Subcellular localization annotation: CTP_CleavageSite=48; ConfidenceScore=5.71e-01
MAEPSKKRKGSSSTTTAAGQHRHGTSSDPPTPPPSFFFFSKLTIRALRTSIAKCSFNALSTTEESDRASISRSHSKRKISELSAAIVFCQAQRMTGAKLKSTYSR

SEQ ID NO: 232951 - protein, 277 aa, Glycine max
  Coding DNA Sequence Number=SeqID_116173
  Pfam annotation: Domain name=Transposase_23; Domain location=48-111; Score=-4.8; E_value=0.0038; Accession=PF03017.5; Description =TNP1ENSPM transposase
MGSQYSPLIEVDLQALAARLSTKGSNVETVDVDPSGDKNVSLKPTMGLYVQRQHTTVLVALGKICEGGSAIHNVTYADDVVRVSVDKVIEGDAEVPFPTSEIQYVWQALQTFIAWPTNLMKKVSHEESDTSPKKLPETDERGTNDFDHDPLRQLIKSLYFMYDTPVELKWDGSKFGLSNVDASFFLTFSDVNEIVARYKCLNISILQLWMLFLDEWSSTLGHASEYGFLEPQSIDHAKDRRAEYVDHAIIISSAMKSANTIADGTNNPATPKWIEVK

SEQ ID NO: 232952 - protein, 536 aa, Glycine max
  Coding DNA Sequence Number=SeqID_116174
  Gene Ontology: Mol. function=ribonuclease P activity; Biological process=tRNA 5'-leader removal
  Homolog annotation: Hit_ID=Q2QZQ0; Match level="QueryCoverage=93%, HitCoverage=58%, E-value=6e-74, Identity=37%"; Hit description =Ribonucleases P/MRP protein subunit POP1 containing protein, expressed
  Pfam annotation: Domain name=POPLD; Domain location=185-270; Score =22.1; E_value=2.1e-07; Accession=PF08170.2; Description=POPLD (NUC188) domain
MAYFSSWHYSISENYWQLKKHVPIEEESVSQNQNSSILKSEDYFSSCAMLSLNVKDPRELPWKKTVVPLESLSTKTPSDAQETKYKELAELGGILEENKDLSSLSRSKLEDSQFDIDDLWYATTRGLRPPVEDNVLSKEKYHERMVNFFLDDIDSGEINSSTKVQCSRSCPILLLKNDMKELIIGWSVILPLSWVKAFWIPLISNGAHAIGLQEKNWISCEMGLPFFPSDFPDCKAYSCLMEAKAAAFNKKAELCPLVTRHLRVPILPPWGIVRITFDKVINAMETPDLSTREDLINANSLPNPCHGNFEISKSDSGSNSFDGTVVRTGCMLTTFLNETKTCQLLLFPYAADGKARISKFINGELKLDPRHRSSDIYDHKQCFVRVHLNPFKEGCFEEGAVICAPYPSDISLWTSSCEKREEGLQMSQSAMRLYFKEHSSGKWGMQIPDDSIARMSHRWPIGFVTTASVQGSKSLVAEGFCEAVLLSNLREEQWKEMPMKKRREIYVLVRNLRSTAYRLALASIVLEYQENDIEFL

SEQ ID NO: 232953 - protein, 47 aa, Glycine max
  Coding DNA Sequence Number=SeqID_116175
MVKCKCEVSAIMFTSRSVNHPGIRNPVLADFFNRLMILRLAIMFPQK

SEQ ID NO: 232954 - protein, 439 aa, Glycine max
  Coding DNA Sequence Number=SeqID_116176
  Gene Ontology: Mol. function=protein binding; Biological process =ubiquitin cycle
  Homolog annotation: Hit_ID=Q9FI63; Match level="QueryCoverage=72%, HitCoverage=69%, E-value=2e-53, Identity=39%"; Hit description =Arabidopsis thaliana genomic DNA, chromosome 5, TAC clone:K21I16
  Subcellular localization annotation: CTP_CleavageSite=34; ConfidenceScore=5.25e-01
MENSLYDELLQEIFQKLPSSSSSSVSLVCKRWLRLHRSSTTSLSLRLTTPHFSLIPSLSSFLSHHPFLSSLSLSLSPPLFSLSPHLLSLIISPFSNLLSLSLTPAPVSLSSLLSLSASCPRLNSLRITLPRPVFLNWLLSFPCLKELSITFSSDDEESHDFDSDSDFELGLGLESICLVGIRSDDWGDRRVLFVFLKSLQGLEEIELRTCRTVVYAVLLELVEHCTSLSSLLVHDGGSKEGLLQFFTQCRCNVRKIDLRLPLDLNNHHLSEMARNFEGLTSVRLQSCCLVSGEGLKALAAALKGLEELALVNCDVVETEPGLLATLGQHLRKLKMLDLSHNEMLHDKEFVSMTVSCVHLIDLKVRGCKGLTSFAMASILRSCKQLQNVDVVNCSGIHSEAVELFVKNCCRLRRMEVEGSKLSDAAKMWAASKFIEVVVV

SEQ ID NO: 232955 - protein, 3136 aa, Glycine max
  Coding DNA Sequence Number=SeqID_116177
  Gene Ontology: Mol. function=protein binding; Cellular component =condensed nuclear chromosome; Biological process=chromosome organization and biogenesis (sensu Eukaryota)
  Homolog annotation: Hit_ID=Q8IHN3; Match level="QueryCoverage=99%, HitCoverage=88%, E-value=9e-84, Identity=20%"; Hit description =Antigen 332, putative
MDNISVVKEEQADHQSEESSVSNVSTKHTTAEGHDTSESSTKLTGDFNGDEHTIVDTRSEENLENKNASEIKAEKETDANQSTDVKTQKTDNEGVHEDKSLQPTHDETSIGNETVAETSRDKRQPEAEFKEKINEEVKTPQNDIEETVEINTNDTEKQEEVPASHADEKQGIEDDGKFDLEEAKGIEEATKAQLPEEEVNTTLPITAFVQGDTDQIPQQQTLQDDDSEVIDIALKIDTSETELAGRSNIVEKPEQPENKDNIGEVKEEQADHQSEELSVSNVSTNYITPEGHVTSECSTKLTGDVDVDGRTIVVTCSEENLENKDACEITSEKETDANQSTDVEIPKTEAKGVYEDKSLQPTLDEALIGNETVAESSRDDRQPEAEFTEKINEEVKPPQNDKEETAEINTNGTEKQEEIPASQAEEKLGIEDDGKFDQEDAKQIEEATKTRLPEEEVKKTLPTAASVHGDTDQIPQQQTLDDDDSEVMDIAKNIDTPEIELGGRSTVVEEPEQSETKDNVGVVKEEQVDHQSEQLSISNVITNYTILEGHITSESSTKLTGDVDVDGWTIVVTRSKENLENKDACEITAKKKTDANQPTDVEIPKTETKGVHEDRSVQPIPDETLISNETVAESDQDERQPEAEFTEKINDEVKTPQNDTLETAEINKNDTEKQEEVPASHAEEKRGIEDDSKFDPEEAKGIEEGTQTQLPEEEVNTTLPTAACVQGDTDEIPQQQTLQDDYSEVIDIAKSIDTPEIELGGRSTVVEEPEQPENVDNVGEVKEEQAGHQSEELSVSNVSTNYTTPEGHITSESNTKLTGDVDVDGRTIVVTHSEETLDNKDDCEITAEKETDANQSTDVDIPKTQTEGVHKDKSLQPTHDEASIGNETVAESSRDERQPEAELTEKINEDVKSPLNDTEETAEINKNDTEKQKEIPASHTEEKLGIEDDGKFDQEDAKQIEQETKTQLPEKEVKTTLPTTAFVQGDTDQIPQQQTLHDDDSEVIDIAKNIDTPEIELGGWSTVVEEPEQPEKTDNIGVVKDVKADHQFEESNVLNGSTNYTTPGGHITSESSKNSTGDVDIDEQIIVDTCSEGNLENKYASEITAEKETDANQLTDVEIPKTETEGVHEDKSLQPTLDETSIGNEIVVESSQDEREEEEEFTEKLNEEVKIPQNDTEETGEINTNDTEKQEEDQASHAKEKLGIEDEGQLYQEEEKGIKEATEPQFPEEEVKITLPTAAFVQGDTDQIPQQQTLHNDESEAIDIAKKIDTPEIELDRRSTVVEEPQQSENKDNVGVLEEEQADHQSEQSSISNVSTNYTIPEGHATSESSTKLTGDVNADEQTIVDTRSEENLENKDTRETTAEKETDANQSTDVEIPKTETEGMHEDNSLQPTLDEASIGNETIAESSQDERQTEEELTEKFNEEVKTPQNDTEETAEINTNDPEKQEEDPASHAEEKLGIENDGKLDQEEAKGIEEATKPQFLEEEVKTTLPTTAFVQGDTDQIQHRQTLHDDESEAIDIAKNIHTLENELGRRSTIVEEPKQPENKDNIGVVKEEQADNQSEQMSMSNGSTNYTIPEGHVTSESSTKSTGDVDVDERTIVDTCLEENLENKDACEITAGKATDGYQSIDVEIPKKEIGGVPEDKALQAIPDTASIGNKALDESSQVERQSEAEFTEKFNEEVQTPKYDTEETAEINTTIDTEKQEGVPASEGKEKLGIEHDGKLDQEEAKGIEEATKMQLPEEKVQTTLPTAAFVQGDADQIPQQQTLHDDESEAINIAKNICTPEIELDEKSTVDEQCEQPETKDNIGILKQQADHQSVQSSVPSVITNYATAEGHVKSKSSTKLTDDVNVDQQKTVDSCSKKNLENKDTSEISAKQAIDAKQSTDAEIPKSETEGVLEDKALQTILDEALVKNEAVDESSPEDRQLEAEFTEKFNEEGQTPQYDIKETAEINTTNATEKQEEVPASNAKENVGVEDDSKFNQEEAKGIEEATIKQLPVEEVETTLPTDSFVQGDTDQKPKQQTLHHDESEVIDIAQNIYTPEIELDRKFIVVEEPEQPETKDIGIVKEEQANHQSQESSMQTVITSYTTAEGHVTSESTTKLTDDVNIYEQKTINARSIEDLENRDASEITAEQVRHTKQSTDGEIPKSETKGVPEDKALQTILDDVTDGNEAVDQSRQEARQPEPKFTEKFNEEVQTTPYDTEETSEINATNDTEKQEKVQASHTKEKLGIEDDGIFYQEEAKGIEEATKMQLLEELVQTTLPTVASVEGDIDQISQQQTLHDDESEAIDNAKSCISEIEPDRKSTAVEYILNQEPEQPETKTNTGIPIEEEADHQSEESSVESLITNYITAEGHVISESSTKLRDDVNVNQQKSVESGLVEFLENKDAGHIRVEGTYSKQLTDAEIQSSETEGPQEEEVHSKLPAVTVQGESDQNLQQQTLDDDESEAINNAKRCIPEKELDRMSTVVEEPETNANVGIVKEEQSDNQSQGSSMQNMIANYITAEGHLASESNTKLNYDVNEQKIVDSQSEENLENKDASKITTEEATDAKQLTDVEIQKLETDGVPENNAMQTLPNIALVRVEEVHDSKQEEIQRDAEFSVTFTKKMQTTQYEFDAKNGIPEAYGEKDDTCHLNAENEQKLESQPVAQNKGTTFINHPYQDGETAEMNPTNGIEVEKIPANHAKEKLVIEDDGKFNQEEAKGIEEATKTLLLNTATESLTEEEVQEILPTPAIVQRDTKQIMQQQTLHNDESEAIDKEKSCIPENELDRKFIAVEESDQPETKANAGIVKEEQADNQSQVSSMQSVITNYITAEGHLASESSTKLSFMNEQKTVDASVENLEIKDASEITAEEATDAKQLTDEEIQKSETESVYEDKALQTLPSTASVRIEVEKSIQEIHTETELAVTDTKEGQISENESEAKKEVSEYMLKKAFDLHKVACQTGAENELKAEFLSEERSQETIVTKHPNLEGESIEINPTSETEEHEQVPASHTGEKLEINDDGNFIQEEEKEMEKETERQLLKTATESVPEDEVQTTLPTSTIVKGETVEGIVQEQTLEEEKSAAIDNNSGRPENKLEGMANVVETIDQHESMAKVSTENEEHANRHSEQSSMENVITKHINSEGM

SEQ ID NO: 232956 - protein, 516 aa, Glycine max
  Coding DNA Sequence Number=SeqID_116178
  Homolog annotation: Hit_ID=Q0PJI2; Match level="QueryCoverage=12%, HitCoverage=24%, E-value=2e-11, Identity=61%"; Hit description=MYB transcription factor MYB183
  Subcellular localization annotation: CTP_CleavageSite=41; ConfidenceScore=5.56e-01
MVRPFFNELQMPLSSSSSSSAAAANSAVSGEIMLFGVRVVVDSMRKSVSMNNLSQYKLPRDAAGYASAADAAPIDSGKNRDRKRVGVKVREITHPGVKVSRFVLEFSNLPEEESDRRKRLLNILSTKLRGGARTNADTQEHPECQGDRYSHKRGWVWTMIKKPYFASNRDHWEQRDFESYGPIKQAGSLIQGDSGMFPQSQGKLSQSENYLSSQSPIDQEPQFNSGNFMALFNHQPLGTPCDVVGSLLGQGVNASQNAVSPPSKDILWASHAMVVAGNPFLRIDFPLDLSISFNLKGTKSPQFDVWWEIVSMSCKCLVNVDIMHYFGIDSKAVELLVKNSSHLRRMKVEGSKLWCCKNLGVKVFWVGDTWMWDFKWRRRWFEWETFLVTTINHMLANVRIQKQGRDSWWWLDDNTGIYSVKYGYRVLHNLLMGSQPTEAFSMIWKLKDVFCAFCGQFEETTPIEPFWQHLHKVLKKEAEMWVEAGYAEYSCVSSFNFSFAQWMSNLALCMSTSWDG

SEQ ID NO: 232957 - protein, 125 aa, Glycine max
  Coding DNA Sequence Number=SeqID_116179
  Pfam annotation: Domain name=zf-CCHC; Domain location=103-117; Score =6.9; E_value=0.071; Accession=PF00098.13; Description=Zinc knuckle
MELYMEEVPKEDTNLKDKQMDGLVISLSDVESLRWASPWLNTLVMNVLNKIFLKVDKLTSIHSSGKFVRICVEIELEKPLISHTYVRSYKLNMEYEGLHSISFRCGRVGHKRDQCSKLMSIPKDA

SEQ ID NO: 232958 - protein, 245 aa, Glycine max
  Coding DNA Sequence Number=SeqID_116180
MTDAPEDKAISTLPEIVEESIQEVIQKEAESEVIDTKEEQRPGNDFVKNMEVLEGFDLHKAQGNTTLENEMKAEVQSEAKSREIIIEHQNLLETAEISPRNDTKEPEKEHKVTTGISESVSADTTEQTDTGKPETPEAEITQPGITKEDEAGDEFEKISPSSSVSVISRDSQDTDTKVSHKKSHGILSGVGSKVKHSISKVKKAITGKTGHYVHVQHFLAYANQWWVKGRAGNARVFAGANEGGV

SEQ ID NO: 232959 - protein, 156 aa, Glycine max
  Coding DNA Sequence Number=SeqID_116181
MGTSKHPSNVAKDDPKVVHAIQPRVRNLNGKNPEVAKGRDLRIGGFSLTAIAFATVIAKIQHLSSISSTVHFDLKCTMRMSWIVSYDMSKAKEKAKKSGILTWIGCASNTRIECTTRYIFISTIITTKVVAIDGDGDQGGGMIYVASGIKRYLKLN

SEQ ID NO: 232960 - protein, 387 aa, Glycine max
  Coding DNA Sequence Number=SeqID_116182
  Homolog annotation: Hit_ID=Q1SFS3; Match level="QueryCoverage=24%, HitCoverage=17%, E-value=2e-08, Identity=37%"; Hit description =Lambda repressor-like, DNA-binding
TIQISLEEKAEALANKREWTSFIDILALLVFGTILFLNVDGLVDLAAIDTYLAYHHSKQSLVITILADTYDTLDLRCEKSSARIIYCTPTLYVWLVSHVFVMKERPLAGSPDGKKEGQECYARYPMRGAPSEEIIACFVARGFNEANAKILQRVRKAWNTVEMKDKELRGSSNGIIGGYHKWLNSRTQGITWLPKLKGLSGKEAEVPKESKEVQALKAELEKTRVIKEKLKTAVTRVRKDCDELRGTERDESRMESMVLEDKLKACQRSKRSLMEREARERVTESLRREAMKWMDRFALTLNGSQGLPRLLAKAKAMINTNEQALRHPYRTCARGRIMSEVDEVQEEMKADMEAMKDQIAPMMEAMLSMKKIMESNATIVATTSAAA

SEQ ID NO: 232961 - protein, 72 aa, Glycine max
  Coding DNA Sequence Number=SeqID_116183
  Homolog annotation: Hit_ID=Q1SYZ2; Match level="QueryCoverage=78%, HitCoverage=11%, E-value=6e-08, Identity=49%"; Hit description =Transposase
MEKSLVGNPYAGRLTKDEKIVVVDMTKSMLKPRNILLTLKEHNANSYTTIKQIYNARHAYHSFIRRSNTEMQ

SEQ ID NO: 232962 - protein, 84 aa, Glycine max
  Coding DNA Sequence Number=SeqID_116184
MEDCTRGSTLCNHEEWLQTHWWRMHERKRRMNENAIYGAPKQGREWRIALSNHYAWLQTRGWRMHERKRNSWGSEKGVENGELH

SEQ ID NO: 232963 - protein, 364 aa, Glycine max
  Coding DNA Sequence Number=SeqID_116185
MRLQRTDLYEVPTLTRTSRYGHVDIFQTHQTQPGHGHRCRVGVGIVSDTGHGKGLECPSVGHDLSHCKRKAVEEQPRPTPKPSTLQNGKFVALIDYSLKRLDNARPTSPRPQIGNSNLVKEEGQNGLSVGIGQQPSAQEASSSDTKDSNLQSAIGVSLESRPAKRQNTSPANTGELPQDPLLEEDGQFTKVLSRSQKKKDKAKSTASTKGKRLKNHFAIHHGPWSFVGNFNSINEAHEKKGGIIPFHLACEEFKAWIDVNLLTYLDTRGVEFTWSNNIKANARIDLRLKKVICNNECFQCWPWLSDCTLPKSKSDHHPILLVVKEVWDTSVSGANQALDWVAFVQQQISTQGPTKDLIAADAQA

SEQ ID NO: 232964 - protein, 951 aa, Glycine max
  Coding DNA Sequence Number=SeqID_116186
  Gene Ontology: Mol. function=protein serine/threonine kinase activity; Cellular component=integral to membrane; Biological process=protein amino acid phosphorylation
  Homolog annotation: Hit_ID=Q9FN37; Match level="QueryCoverage=99%, HitCoverage=93%, E-value=0.0, Identity=48%"; Hit description =Putative receptor protein kinase
  Pfam annotation: Domain name=LRR_1; Domain location=103-124; Score =7.4; E_value=12; Accession=PF00560.23; Description=Leucine Rich Repeat
  Pfam annotation: Domain name=LRR_1; Domain location=127-149; Score =14.4; E_value=0.42; Accession=PF00560.23; Description=Leucine Rich Repeat
  Pfam annotation: Domain name=LRR_1; Domain location=151-173; Score =9.5; E_value=4.7; Accession=PF00560.23; Description=Leucine Rich Repeat
  Pfam annotation: Domain name=LRR_1; Domain location=175-197; Score =14.8; E_value=0.31; Accession=PF00560.23; Description=Leucine Rich Repeat
  Pfam annotation: Domain name=LRR_1; Domain location=223-245; Score =18.5; E_value=0.024; Accession=PF00560.23; Description=Leucine Rich Repeat
  Pfam annotation: Domain name=LRR_1; Domain location=247-269; Score =13.1; E_value=0.99; Accession=PF00560.23; Description=Leucine Rich Repeat
  Pfam annotation: Domain name=LRR_1; Domain location=271-293; Score =11.4; E_value=2.1; Accession=PF00560.23; Description=Leucine Rich Repeat
  Pfam annotation: Domain name=LRR_1; Domain location=295-316; Score =10.5; E_value=3.2; Accession=PF00560.23; Description=Leucine Rich Repeat
  Pfam annotation: Domain name=LRR_1; Domain location=31-53; Score =16.7; E_value=0.083; Accession=PF00560.23; Description=Leucine Rich Repeat
  Pfam annotation: Domain name=LRR_1; Domain location=346-368; Score =8.2; E_value=8.3; Accession=PF00560.23; Description=Leucine Rich Repeat
  Pfam annotation: Domain name=LRR_1; Domain location=370-392; Score =15.9; E_value=0.15; Accession=PF00560.23; Description=Leucine Rich Repeat
  Pfam annotation: Domain name=LRR_1; Domain location=394-416; Score =18.7; E_value=0.02; Accession=PF00560.23; Description=Leucine Rich Repeat
  Pfam annotation: Domain name=LRR_1; Domain location=456-478; Score =1.0; E_value=1.8e+02; Accession=PF00560.23; Description=Leucine Rich Repeat
  Pfam annotation: Domain name=LRR_1; Domain location=480-502; Score =17.2; E_value=0.059; Accession=PF00560.23; Description=Leucine Rich Repeat
  Pfam annotation: Domain name=LRR_1; Domain location=504-526; Score =22.2; E_value=0.0018; Accession=PF00560.23; Description=Leucine Rich Repeat
  Pfam annotation: Domain name=LRR_1; Domain location=55-76; Score =11.1; E_value=2.4; Accession=PF00560.23; Description=Leucine Rich Repeat
  Pfam annotation: Domain name=LRR_1; Domain location=7-29; Score=18.4; E_value=0.026; Accession=PF00560.23; Description=Leucine Rich Repeat
  Pfam annotation: Domain name=LRR_1; Domain location=78-101; Score =8.2; E_value=8.5; Accession=PF00560.23; Description=Leucine Rich Repeat
  Pfam annotation: Domain name=Pkinase; Domain location=667-938; Score =161.6; E_value=2.1e-45; Accession=PF00069.15; Description=Protein kinase domain
  Pfam annotation: Domain name=Pkinase_Tyr; Domain location=667-938; Score=109.5; E_value=9.5e-30; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::Pkinase::Pkinase_Tyr; Domain location=103-124::...
  Pfam module annotation: Domain location=127-149::151-173::175 -197::223-245::247-269::271-293::295-316::31-53::346-368::370 -392::394-416::456-478::480-502::504-526::55-76::7-29::78-101::667 -938::667-938
SLAYLDKLKELNLSFNRLQGELSSEFSNLKQLQVLDLSHNMLSGPVGGAFSGLQSIQILNISSNSFVGDLFHFGGLQHLSALNISNNSFTGQFNSQICSTSKGIHILDISKNHFAGGLEWLGNCSTSLQELHLDSNLFSGPLPDSLYSMSALEQLSVSVNNLSGQLSKELSNLSSLKSLIISGNHFSEELPNVFGNLLNLEQLIGNTNSFSGSLPSTLALCSKLRVLDLRNNSLTGSVALNFSGLSNLFTLDLGSNHFNGSLPNSLSYCHELTMLSLAKNELTGQIPESYANLTSLLTLSLSNNSFENLSGALYVLQQCKNLTTLVLTKNFHGEEIPEKLTASFKSLVVLALGNCGLKGRIPAWLLNCPKLEVLDLSWNHLKGSVPSWIGQMDRLFYLDLSNNSLTGEIPKGLTQLRGLISSNYHISSLFASAAIPLYVKRNKSASGLQYNHASSFPPSIYLSNNRLSGTIWPEIGRLKELHILDLSRNNITGTIPSSISEMKNLETLDLSYNSLVGTIPPSFNSLTFLSKFSVAYNHLWGLIPIGGQFSSFPNSSFEGNWGLCGEIFHHCNEKDVGLRANHVGKFSKSNILGITIGLGVGLALLLAVILLRVSKRDEDKPVDNIDEELSCPNRRPEALTSSKLVFFKNSDCKDLTVEDLLKSTGNFNQENIIGCGGFGLVYKGNLPNGTKVAIKKLSGYCGQVEREFQAEVEALSRAQHKNLVSLKGYCQHFSDRLLIYSYLENGSLDYWLHESEDGNSALKWDARLKIAKGAAHGLAYLHKECEPHIVHRDIKSSNILLDDKFKAYLADFGLSRLLQPYDTHVSTDLVGTLGYIPPEYSQVLKATFKGDIYSFGVVLVELLTGRRPVEVIIGQRSRNLVSWVLQIKSENREQEIFDSVIWHKDNEKQLLEVLAIACKCIDEDPRQRPHIELVVSWLDNVGFDGSEQSSF

SEQ ID NO: 232965 - protein, 272 aa, Glycine max
  Coding DNA Sequence Number=SeqID_116187
  Gene Ontology: Mol. function=monooxygenase activity; Cellular component=membrane; Biological process=electron transport
  Homolog annotation: Hit_ID=Q1RYU2; Match level="QueryCoverage=95%, HitCoverage=45%, E-value=3e-74, Identity=54%"; Hit description=E -class P450, group I
MEPLFSSAAAICVVTVLVAVIPIWALKMLNSLWLRPKRFERLLRAQGFHGDPYSLSHHNSNQTLLQQHQLNSQPFPLSDDVAPRVSSLLHHTIDKYGEKSIFEAQNLFEQLLISKGCAGKKSFFWEGRTPKVIITDPNQLKEVFNNIHDFQKPKFSDNVKFLFAGLLNYEGDKWAKHRRIMNPAFHSEKLKNMLPAFSQSCHDMISMWKGMLSSDGKCEIDIWPFLQNLTRDVISQTAFGSSYAEGEKFFRNLRMQGYLLMAGKYKNIPILR

SEQ ID NO: 232966 - protein, 59 aa, Glycine max
  Coding DNA Sequence Number=SeqID_116188
MEYLLVGDEQKRKTESKNAKKDDPRAANSSIPWVWLLKGGKRRVARPGEPSSLRRAQLA

SEQ ID NO: 232967 - protein, 129 aa, Glycine max
  Coding DNA Sequence Number=SeqID_116189
  Gene Ontology: Mol. function=nucleic acid binding
MDKLQMLRQGSMSAEKYRQQMELLLLRAGLREEERTSIARFLSGLNMEVRDKVELLPYRDLDELVQLCIKVEQQLKRKPSSKSYGFHSYPRNDKAQGILGAAPRDGNRLGWPTGAYDLAYIKLGLTWPI

SEQ ID NO: 232968 - protein, 108 aa, Glycine max
  Coding DNA Sequence Number=SeqID_116190
  Gene Ontology: Mol. function=nucleotide binding; Cellular component =membrane; Biological process=small GTPase mediated signal transduction
  Homolog annotation: Hit_ID=Q39860; Match level="QueryCoverage=66%, HitCoverage=32%, E-value=2e-23, Identity=78%"; Hit description=GTPase
  Pfam annotation: Domain name=Ras; Domain location=11-102; Score= -37.7; E_value=1.9e-06; Accession=PF00071.12; Description=Ras family
MITFGVLPSQRKDFLPAHPLLISNSSKRLQQLRSILTTHCDKTVAMMLVGNKCDLENIRAVNIDEGKSLAEAEGLFFMETSVLDSTNVKTAFEMESGYKLYNWVTKSL

SEQ ID NO: 232969 - protein, 88 aa, Glycine max
  Coding DNA Sequence Number=SeqID_116191
MEVERHNKREKRLTSMVDSGAAQCTFFSDNSLSSSTSFLSSVVSSAMEERKLVEDDKELLEEKLGGPWTTNTYHKQYQYQFNGGEGGD

SEQ ID NO: 232970 - protein, 141 aa, Glycine max
  Coding DNA Sequence Number=SeqID_116192
  Homolog annotation: Hit_ID=Q1RU92; Match level="QueryCoverage=47%, HitCoverage=13%, E-value=6e-13, Identity=46%"; Hit description=IMP dehydrogenase/GMP reductase
MLVRILDLRQEHWSPKLLFEIIKGIDSPIVLDEATKSRSFGHFARVLVDLDLTGKLLSEFLVERESFAFFRLWVMISSFVREKQLRNNQDQHQSLAPSKKGSLLLLLIIPSKIPDHACPTSLRPEIGNSNLVEEGQNDLFV

SEQ ID NO: 232971 - protein, 102 aa, Glycine max
  Coding DNA Sequence Number=SeqID_116193
  Gene Ontology: Mol. function=binding; Cellular component=membrane coat
  Homolog annotation: Hit_ID=Q2RBN7; Match level="QueryCoverage=71%, HitCoverage=6%, E-value=3e-24, Identity=53%"; Hit description =Clathrin heavy chain, putative, expressed
MYVKPYMVVVQSNNIEKHELLKIRRVTTYIYKKAGRWKQSIALSKKDNLYKDAMETASQSGDRELAEELLVYFIDQVDNIGTNEAKENGSSNEQAIWLVAAR

SEQ ID NO: 232972 - protein, 86 aa, Glycine max
  Coding DNA Sequence Number=SeqID_116194
MGVQIVIFESGPSRGFWAISCLSWITSGGSNTARLGELGGNLLPLFPINRLKGAVLRVLDPPDDVFQLFWVKKIVSVMKIQAEVLP

SEQ ID NO: 232973 - protein, 153 aa, Glycine max
  Coding DNA Sequence Number=SeqID_116195
MFILTPIAINSPLTYKWAHMCIPTVIATSLAISCDSSSFSSDCSDRVSKRQREGEGIEASILYCLCAMRISPSIDIVLQIPTLKRRSISVENADCVLCGSGGEEVSHLFVLYQFSNQVWSTVYKWWDVRHKGNGSSSLNYIPGFHNRVSSPME

SEQ ID NO: 232974 - protein, 69 aa, Glycine max
  Coding DNA Sequence Number=SeqID_116196
MEREAKRELYRIHCSSEENNIEDDIEGGIGVGCAPEALWCQVPMVAVEVEAPFHFFDDSAIVGVFNFNR

SEQ ID NO: 232975 - protein, 70 aa, Glycine max
  Coding DNA Sequence Number=SeqID_116197
  Gene Ontology: Mol. function=RNA-directed DNA polymerase activity; Biological process=RNA-dependent DNA replication
MAPENIEKTTFVTLWGTLCYKVMSFGLKNTGATYQRAMVALFHDMTHKEIEVYVDDMIAKSRTEEEHLVN

SEQ ID NO: 232976 - protein, 1076 aa, Glycine max
  Coding DNA Sequence Number=SeqID_116198
  Gene Ontology: Mol. function=RNA-directed DNA polymerase activity; Cellular component=chromatin; Biological process=chromatin assembly or disassembly
  Pfam annotation: Domain name=RVP_2; Domain location=325-443; Score= -64.1; E_value=0.097; Accession=PF08284.2; Description=Retroviral aspartyl protease
  Pfam annotation: Domain name=RnaseH; Domain location=742-861; Score= -30.3; E_value=0.038; Accession=PF00075.14; Description=RNase H
  Pfam module annotation: Pfam domain module=RVP_2::RVT_1::Retrotrans _gag::RnaseH; Domain location=325-443::523-688::92-182::742-861
MERWEDAFAKLSASMTSKFDELLSRMNQLETSHANTHAPSSFAAASAASTSNAAYRLKLEVPRFDGTDPEGWIFKVTQFFEYHATSKPDRLTITSFYMEGPALAWFQWMYRSGQLSSWSAFLHAIHARFSSSAYEDPTGVLCKLTQRTTVSAYLSEFETLANRVIGLPVPFVLSCFISGLNPAIWREVQVMQPHSLAQAVSFARLHEEKFLDSRRQGSKPSSSISSGTSATRPPSSLNAPLQDSSLLPSASRPRASTIPFKRLTPSELALRREQGLCFNCEEKYSRGHKCASSLFLFVTEEDDDNRDMDPGPSQLTPSSQESSPTQISLHALSGHGAPKTLRLTGLIHDHRVQILIDGGTSLQLQPCETSTLRVTVGNGEELQCNQVCTNIAVRIQKHEFQVDFHVLPIQGLDVVLGVQWLKALGPVLTDYTTLTMKFIYNGQLIELVGDRDSSLQMISPSQLQRWVDTALPPSRPIDHAITLLPHLAPVNVKPYRYPHFQKQEIETQVAAMLRQGHIQHSSSPFSSPILLVKKHDGTWRFCVDYRALNAITIRDRFPIPTVDELLDELGGAVWFSKLDLMQGYHQILMKEFDISKMAFRTHHGHYKFRVMPFGLCNAPSTFQATMNRLFQPHLRRYIIVFFDDILIYSRILDEHLNHLEIVFQVQAIQAWPQPRSTRALRGFLGLVGFYRRFIKGYAMIAHPLSQPLTKAELVWSLEAESAFHMLKKAVTMAPVLALLDFTKPFMVETDASGLGIGTVQDGHPISFFSKQFCPRLLRSSTYVRELAAITAAVKKWRQYLLGHHFIILTDHRSLKKLMNQAVQTLEQHKYLARLLGFDYVIQYRAGKSNVVADALSRSGVSAPASLFIISVPHFVFLEDLRRELQANPEFTELRKKMIVEPHAYPDHSLAQDLILYRGRIWLPPNCSFIKILLSEFHQSLTGGHMGFRKTLNRVTKNFMWETSTRDTRDFVSNCLECQLVKYEPAKPRGLLYPLPVPSQPWEDLSMDFIVGLPAYRGNTCMLVIVDRFSKGVHLGMLPPHHTSQTVAQLFMEMVGKLHGMPRSITSDRDPLFLSKF

SEQ ID NO: 232977 - protein, 185 aa, Glycine max
  Coding DNA Sequence Number=SeqID_116199
  Gene Ontology: Mol. function=structural constituent of ribosome; Cellular component=ribonucleoprotein complex; Biological process =translation
  Homolog annotation: Hit_ID=Q9M5M7; Match level="QueryCoverage=66%, HitCoverage=63%, E-value=3e-49, Identity=74%"; Hit description=60S ribosomal protein L10
  Pfam annotation: Domain name=Ribosomal_L10e; Domain location=20-183; Score=184.9; E_value=2e-52; Accession=PF00826.8; Description =Ribosomal L10
  Subcellular localization annotation: CTP_CleavageSite=11; ConfidenceScore=5.01e-01
MVQQLSRPYLSCALSVSHSAALSPFPFSLAIEPQSFPSLKEAVNSKPKKKKGTYSIYDVGMKKKGVDEFPFCVHLVCWEKENVSSEALESAFHLRVRMDPSHVLRINKMLSCAGADRLQIGMRGAFGKLLATCARVAIGQVHLSVCCKDNNNHHAQEALRCAKFKFLRCHKIIVSRKWYVSGHGY

SEQ ID NO: 232978 - protein, 75 aa, Glycine max
  Coding DNA Sequence Number=SeqID_116200
  Gene Ontology: Mol. function=transferase activity; Cellular component= chromatin; Biological process=DNA integration
  Homolog annotation: Hit_ID=Q1SPQ1; Match level="QueryCoverage=96%, HitCoverage=16%, E-value=7e-14, Identity=48%"; Hit description =Polynucleotidyl transferase, Ribonuclease H fold
MPTICQTINNNPDNCVIGRRRQISDEVHGDVFPNLIGNWQWLEETKGFHSFSQTLKPFCTFQTNKRLQITALEWP

SEQ ID NO: 232979 - protein, 200 aa, Glycine max
  Coding DNA Sequence Number=SeqID_116201
  Gene Ontology: Mol. function=RNA-directed DNA polymerase activity; Cellular component=chromatin; Biological process=RNA-dependent DNA replication
MAMLIADMLKEGIIRPSTSPYSSSVLLVKKKDGSWHFCVDYRTFNALTVRDRFPIPTIDELLDELKGASFFSKIDLRSGYHHVRLAEKDIPKMGFQTFDGHYEFLVMPFGLTNALSSFQAAMNDLLHPFLCKFVLILLLLYQHQFYAKFSKCRFGVTSVDYLRHIISHQGVQVDSDKIRAMMDWPTPTSLTTLRAFLGLT

SEQ ID NO: 232980 - protein, 275 aa, Glycine max
  Coding DNA Sequence Number=SeqID_116202
  Homolog annotation: Hit_ID=Q9FJK3; Match level="QueryCoverage=37%, HitCoverage=31%, E-value=9e-09, Identity=35%"; Hit description =Similarity to MADS-box DNA-binding protein
PLARLASCSTGVRYLIGNGDLVEEGAGSANLLGGVGSKGGRVLGGIHGGLANKVGVACSLVSTSLRPKRKQFIMAVLGHVGDFQSHWNQPYSMKAGKGDEQEQWNSVKKLFNLEYPFKGGVYGAGWWGWWIVGFVFYKQFLKELESFKLDDFGFFSVGSSHHVRIPARDFWPFESGVLNGLGKFMCMPQWEQTKKMVDEEHFIAQSNVKGKEKLKKLVDENKEKEMSLFMVQWLKTRKVQPEHNMTKADFNAVSSMIDQNRKDIAERMEILSVSE

SEQ ID NO: 232981 - protein, 72 aa, Glycine max
  Coding DNA Sequence Number=SeqID_116203
MGPKSTLRLIRTLGPSLALHTFLAWPTHLVKSLSHQVAVSPPKPPPKPDPEVDDPLYLMTLTILELFLRPYQ

SEQ ID NO: 232982 - protein, 308 aa, Glycine max
  Coding DNA Sequence Number=SeqID_116204
  Gene Ontology: Mol. function=N-acetylmuramoyl-L-alanine amidase activity; Biological process=peptidoglycan catabolic process
  Homolog annotation: Hit_ID=UPI00006DBB96; Match level="QueryCoverage =62%, HitCoverage=79%, E-value=2e-72, Identity=74%"; Hit description =COG0860: N-acetylmuramoyl-L-alanine amidase
  Pfam annotation: Domain name=Amidase_3; Domain location=113-307; Score=17.8; E_value=2.1e-07; Accession=PF01520.9; Description=N -acetylmuramoyl-L-alanine amidase
  Subcellular localization annotation: CTP_CleavageSite=20; ConfidenceScore=5.34e-01
MSFASARALRRCSCGDSRVRGNRGRQATGNAWVVTNPPRSAASCHCRPRPAARESAAVGAATGVATRVLYRAKTNVPAVMDGRVGGKMAGRWARRIAASVLGLAAGLAQAAHVVVDTGHTPRQPGATGASGRVEYLYNLDLSGAVAADLQASGDRVTRVSADGAEVPLGRRTRIAPGADFFISIHHDSMQQHYIDAGRQREFAGFSIFVSRLNPRYEDSLRCAKAIGEALLAAGEKPSLYHAEPIAGENRPLLDPRLGVHRYDGLAVLKTATMPAVLVEAGVIVNPDEESPAGQARDHPAAGSRDCRW

SEQ ID NO: 232983 - protein, 135 aa, Glycine max
  Coding DNA Sequence Number=SeqID_116205
  Gene Ontology: Mol. function=3-oxoacyl-[acyl-carrier-protein] reductase activity; Cellular component=membrane; Biological process =metabolic process
  Homolog annotation: Hit_ID=Q38ZT9; Match level="QueryCoverage=70%, HitCoverage=36%, E-value=9e-36, Identity=82%"; Hit description=3 -hydroxybutyrate dehydrogenase
  Pfam annotation: Domain name=adh_short; Domain location=47-135; Score= -58.4; E_value=0.039; Accession=PF00106.15; Description=short chain dehydrogenase
  Subcellular localization annotation: CTP_CleavageSite=51; ConfidenceScore=5.30e-01
MVTGAWRSGRSHFGALPSKPCPSHPRAHPGSRHPYPEVPSMSNLNGKVAVVTGAASGIGKEIALTLSRAGAAVAIADLNQAGADAVAREIEQAGGKAMGVAMDVTNEDAVNQGIDRVAAAYGSIDILISNAGIQI

SEQ ID NO: 232984 - protein, 51 aa, Glycine max
  Coding DNA Sequence Number=SeqID_116206
MVEEKHTYQAKNNKVDRDSWSSMDWKALELEASSSLLGRPVHGSEKGKIKN

SEQ ID NO: 232985 - protein, 119 aa, Glycine max
  Coding DNA Sequence Number=SeqID_116207
MVNQESFIADTIQKGGDQIKKIVKDNKEMEMTILMYQCFNTGIVEPSNNMTMSDLNVLFVCDIALCGASRPWIFFINGVLCFLKINGSEMENENDWRHHFKEKMSQEEAHHHRKPWIRA

SEQ ID NO: 232986 - protein, 68 aa, Glycine max
  Coding DNA Sequence Number=SeqID_116208
  Subcellular localization annotation: CTP_CleavageSite=34; ConfidenceScore=5.40e-01
MRFAYVRKASRCSSGSVVSSYRLRLSGFHPKGMSASIIRSTKRCRQTIRVAGQCMYEGLRSSIVLLMR

SEQ ID NO: 232987 - protein, 77 aa, Glycine max
  Coding DNA Sequence Number=SeqID_116209
MWQRGLHQSVIEQKLRDITRRMEMLNVNEAVVLRPPQQPEMQTPVEALPPVAPPEETATTLNYDHGASDVNADPLQS

SEQ ID NO: 232988 - protein, 531 aa, Glycine max
  Coding DNA Sequence Number=SeqID_116210
  Gene Ontology: Mol. function=peptidase activity
  Homolog annotation: Hit_ID=UPI000067F943; Match level="QueryCoverage =99%, HitCoverage=48%, E-value=0.0, Identity=66%"; Hit description =Transglutaminase-like
  Pfam annotation: Domain name=Transglut_core; Domain location=1-57; Score=32.1; E_value=2e-06; Accession=PF01841.9; Description =Transglutaminase-like superfamily
MRNLGLAARFVSGYLIQLKADVEALDGPSGTDKDFTDLHAWTEVFIPGAGWVGLDPTSGLMAGEGHIPLACTALPSSAAPVTGFTDVAEVTFSHEMKVTRIHEDPRVTKPYSEKDWQAILKLGEQVDKQLTKMDVRLTQGGEPTFVSIDDMDGAQWNTAALGEHKRKLAGELALRLKDHFAPHGFLHYGQGKWYPGEPLPRWAINIYWRPDGKPVWRDASLFSAEGLGDGYGIKQAQVFATHLADILGFPKACVMPAYEDVMSLAQQEQQLPANIDPLKADLKDAAERKRLASLLSQGLGQVVGYIMPLKPDESRSAGEWLTSKWPLRREHLYLLGGDSPMGLRLPLSSLPWQLPADIEPEFAPDTFAEKTALDETKTPTVRVKHQTTQPTAREVIHTALCVQVRQGRLYVFMPPVTRLEDYLDLLSAIEQTASDLKLKLWLEGYTPPRDSRLKLLSVTPDPGVIEVNIHPAKSWKELVANVGTLYEEARLCRLATEKFMLDGRHTGTGGGNHVTLGGETAADSPMLRRPD

SEQ ID NO: 232989 - protein, 377 aa, Glycine max
  Coding DNA Sequence Number=SeqID_116211
  Gene Ontology: Mol. function=peroxidase activity; Biological process =glutathione biosynthetic process
  Homolog annotation: Hit_ID=UPI000067F944; Match level="QueryCoverage =85%, HitCoverage=38%, E-value=1e-120, Identity=62%"; Hit description= conserved hypothetical protein
  Pfam annotation: Domain name=DUF404; Domain location=60-376; Score =424.7; E_value=1.3e-124; Accession=PF04169.4; Description=Domain of unknown function (DUF404)
MSRIPAGVRTAPSRSMPMKRRRVDLHASGRMGIHRAGWMWPSCEHPVTLSVLSLLNQLYFSDRYNELLDSSGQARPHWQALVSQLETEEPTAMRKRIEAVQRQIRDNGVTYNVYADTHGVQRPWDLDVLPLIIPQEEWQHIAASVAQRATLLNRVLLDIYGEQRLLSSGQLPPALIYGHSGFLPSCVGIPHYDNMALHSYAVDLARAPNGQWWVVSDRTQTPTGAGYALENRTIISSAFPELFRDLNIERLSGFFASMRDSLAHWGHRVAANQAQTVPGVTALGQGEPPLIVILTPGPYNETYHEQSFLAGYLGYPLVHGSDLTVRNGIVWLKTIAGLKPVHVILRRIDDDYCDPLELNADSLLGVAGLTQAARLGN

SEQ ID NO: 232990 - protein, 184 aa, Glycine max
  Coding DNA Sequence Number=SeqID_116212
MQENKLCFLENEMNSLSEHVVLSEFINTHCMLSEAESLSPESRKRARIEDIPSSSTPTPPLVTVGQDVQSSLTVVPMLQSLFRGQFIIMHSLQELAHNRPIISMENFLEQVAWPEDQLPLVNSEPANPQSSVVNPPSSPKIEAVPLSPPLIVIFDASSNEATAPPDSPAAETADPPCFPNWRNC

SEQ ID NO: 232991 - protein, 423 aa, Glycine max
  Coding DNA Sequence Number=SeqID_116213
  Gene Ontology: Mol. function=RNA-directed DNA polymerase activity; Biological process=RNA-dependent DNA replication
  Homolog annotation: Hit_ID=Q8H6Q8; Match level="QueryCoverage=98%, HitCoverage=14%, E-value=2e-47, Identity=28%"; Hit description=CTV.20
MDRNILDSLFLNIHFHGLDMKEGSIPAALIYRIQYKVMNTCASRVLLKPQRGETTLFITDMTKANVSLPRKIKWDEVTLPERWVMDKATPSIPRPAPTIEHIKQDNSGKVEITFNRRNSFSSRIEASRSEYESARRSFSVRTRSIPVGLTRSESHNQFPTVNLQGLDTTSSIPRTTYNQEQEDDQNIDKETLRKDFYSPENEPQKRWFFQHYKGTNRKQIQDKFYEFVERVKINVIFFDWFHAYAIRKDIDYPWKQDIIGDPTTNVITNWQVKDGELIQSELPPTTQYQLPNIKDSNNKPVMAIPFKTKDVNEEVTSKDIKSLMEQANYTNKYLQALGETIKTKVVPKQKSIEEASPSVPIEKPLFKPFKVSEKAKRKIRELRKTKSLTEGVGDNHSELLNTIGSLLKVIPDTPQASEILPKW

SEQ ID NO: 232992 - protein, 88 aa, Glycine max
  Coding DNA Sequence Number=SeqID_116214
  Gene Ontology: Mol. function=nucleic acid binding; Biological process= DNA integration
  Pfam annotation: Domain name=zf-CCHC; Domain location=45-62; Score =29.0; E_value=1.6e-05; Accession=PF00098.13; Description=Zinc knuckle
EERLQRDISKSAHLSCTSQNKKRKKTKGATKGSSQQKKLKKDEEFTCYFCKKSGHMKKECPKYLMGGFWCYYSHKCNHAGLPVEPTAK

SEQ ID NO: 232993 - protein, 174 aa, Glycine max
  Coding DNA Sequence Number=SeqID_116215
MSSEPPFFHRIIPNAWNTHQCNKNKSLTLTLPQNHGGSDDHLPLYHFNATEKEKLDYNPKKIPLNLLPKIVCLTFAALGYQTITSQDQPCILGPAIVIAFVASLSVVLFSNNDTITRSYPRLAAIVELIGYLSFTLSFLVMIRVFFSGNLILWIIIGGLAMGWIMLILLIRLFT

SEQ ID NO: 232994 - protein, 141 aa, Glycine max
  Coding DNA Sequence Number=SeqID_116216
MKQKGKRKKDREGRHVIVKKYKSFVKRKRIFWKQGTDAKSLFSGITEIRMDEFIELMKEHNLETLESSFFPPKQRTVESPQGRANKMLKPDFPKKGKEEVGRTGINDKKRKNKNNKKERKRTIPDQRSKGSETGKDRRKTE

SEQ ID NO: 232995 - protein, 229 aa, Glycine max
  Coding DNA Sequence Number=SeqID_116217
  Gene Ontology: Mol. function=metal ion transporter activity; Cellular component=integral to membrane; Biological process=metal ion transport
  Homolog annotation: Hit_ID=Q8SBD0; Match level="QueryCoverage=99%, HitCoverage=61%, E-value=3e-66, Identity=58%"; Hit description=Iron regulated metal transporter
  Pfam annotation: Domain name=Zip; Domain location=1-226; Score=116.2; E_value=9.6e-32; Accession=PF02535.12; Description=ZIP Zinc transporter
MLAAVFTLMVDSFSINYFRKKLTTSTAESTTASSLEAGENKEGDMFGHGHCHGHVNGHRGDGMSVNGEQLLRYRVVAQVLEMGIVVHSVVIGLSLGASLNPCTIRPLIAALCFHQLFEGMGLGGCILQAEYGMKVKAIMVFFFSATTPFGIALGIGLSNVYSDASPTALIVEGILNAVSAGLLNYMALVELLGADFMGPKLQGRTNVMAWAFVAVLLGAGGMSVMAIWA

SEQ ID NO: 232996 - protein, 36 aa, Glycine max
  Coding DNA Sequence Number=SeqID_116218
MSGNDWLKEICSNSACAKEDRVNDTGSCPGREFFNL

SEQ ID NO: 232997 - protein, 351 aa, Glycine max
  Coding DNA Sequence Number=SeqID_116219
  Gene Ontology: Mol. function=binding; Cellular component=membrane; Biological process=proteolysis
  Homolog annotation: Hit_ID=Q3XV38; Match level="QueryCoverage=73%, HitCoverage=63%, E-value=3e-53, Identity=45%"; Hit description=Sel1 -like repeat precursor
  Pfam annotation: Domain name=Sel1; Domain location=107-146; Score =7.0; E_value=2.2; Accession=PF08238.2; Description=Sel1 repeat
  Pfam annotation: Domain name=Sel1; Domain location=147-182; Score =41.9; E_value=2.1e-09; Accession=PF08238.2; Description=Sel1 repeat
  Pfam annotation: Domain name=Sel1; Domain location=183-218; Score =26.8; E_value=7.8e-05; Accession=PF08238.2; Description=Sel1 repeat
  Pfam annotation: Domain name=Sel1; Domain location=219-254; Score =45.4; E_value=1.9e-10; Accession=PF08238.2; Description=Sel1 repeat
  Pfam annotation: Domain name=Sel1; Domain location=255-290; Score =53.1; E_value=9.1e-13; Accession=PF08238.2; Description=Sel1 repeat
  Pfam annotation: Domain name=Sel1; Domain location=291-326; Score =39.4; E_value=1.3e-08; Accession=PF08238.2; Description=Sel1 repeat
  Pfam module annotation: Pfam domain module=Sel1::Sel1::Sel1::Sel1::Sel 1::Sel1; Domain location=107-146::147-182::183-218::219-254::255 -290::291-326
  Subcellular localization annotation: CTP_CleavageSite=40; ConfidenceScore=5.11e-01
MDRGAARDVPGHGPIAPGLSSTLRMRRKAWNPFRVCGDPRDSGARRGFDFLGSFPPRRGQPTHPAAPAGPPGAMARGAPGAGLMLRAAGGRRARRPGPDVRECARRREGRCASGGMVAPRRRAGGSRRADYALAAQWCEKAAVQGNAEAQTMLGRMYAQGQGVARQEDLAVQWWRRAADQGYAEARYQLGDHFFDAPAPRRDDAQARRWFALAAAQGHAEAQNNLGVMYADGLGGPREVGKAVEWFRKAAEQGLPKAQNNLGAMYFTGSGVPADDKLAVQWWRRAADQGNAAAQDRLGGAYLSGRGVPQDDLHASQWLRKAAEQNHAPAQDTLGTLYEQGRGVPKDESQAV

SEQ ID NO: 232998 - protein, 243 aa, Glycine max
  Coding DNA Sequence Number=SeqID_116220
MASRKRKAPSTPTQVRFDRSRFTSQEAWERYTYIIVPRKLLPERNVVDEELTDFGDGNIDVAIVKEFYTNLYDRKDKSPKQELAAKLCIPGRGFELNADGQPLKILRKNMTTLAQTWSVLSFSNLIPTSQLLMKARGNRSKVLFIAALEAPTPSSSTLPPSSSIDIPPADQPSSSGRGGASTAQEPVTEEPTTPASSPAVAEEENTPTQTPQPSPPSAPSLEETHPSSALDLNEDQPQEEQDV

SEQ ID NO: 232999 - protein, 88 aa, Glycine max
  Coding DNA Sequence Number=SeqID_116221
MILDDYEGEEHYCGKGTNVRSVSFLPRSQEKIRDSAKVVIKQDMKGGEHKYGFNNNKREKPEKVRVVDDETGDKHELYEVLRMPSRCV

SEQ ID NO: 233000 - protein, 653 aa, Glycine max
  Coding DNA Sequence Number=SeqID_116222
  Gene Ontology: Mol. function=RNA-directed DNA polymerase activity; Cellular component=chromatin; Biological process=chromatin assembly or disassembly
  Homolog annotation: Hit_ID=Q8GW20; Match level="QueryCoverage=37%, HitCoverage=40%, E-value=1e-66, Identity=55%"; Hit description =Protein At5g03900 precursor
  Pfam annotation: Domain name=Chromo; Domain location=338-392; Score =32.7; E_value=1.2e-06; Accession=PF00385.14; Description='chromo' (CHRromatin Organisation MOdifier
  Pfam annotation: Domain name=zf-H2C2; Domain location=182-220; Score =8.9; E_value=0.024; Accession=PF09337.1; Description=His(2)-Cys(2) zinc finger
  Pfam module annotation: Pfam domain module=Chromo::zf-H2C2; Domain location=338-392::182-220
MDPTKVQVVVNWRTPLNAKDQDCPTFKALTKKDGFCWGSAQASAFEDLKRLLMQDRQPNAYFSKALSPWTISKLVYKKEIMALTLSVQHWRHYLFGRSFKLMGYQFEVIYKPGPDNKDANALSCQHLAPELHAISISPYWVYFPRIRAEVQQDPNSAQLSSALQSNPNTNRNYTLRDGFLFFKGGHSGFTKTYKRLALSFLWKGMQKSIMDYICRCDVCQRNKYHAMSPVGLLQPIPILERIWEEISMDFITGLPRSQGYEVNSSGSLHTGWDHVQDEHHLHPRIDGQMEVVIGNLPLLLCFKTAYQVAFVVVLGRILNGSAVSSLPLMLEIDDSETSSPEAILATRVRKHQGTPMEEWLILWTSQPTEEATWEVAHSIKDKFPSFYLEDKANFIGDELGAVRTFLKLGGASALDDESYILPVLLRFDGQPEVDEETTASQKSKRKEYVGRRWADWVGIEKFFKEKKWQFSITGTSERAMVIGLGGLNLFGVIILGTMLKDTAVAPSSFIKFVADIFPLLQNVGLGLNSIQKLAQEIYAGSFFAIPLVRWFFIRKKNADIEKRNKARQQCAQVLELPDTSLRQKSTVKIRETDGFLSENRVPEYAVDIWLYSARDMAEKTVIGQDQIVYSTDKDLLEQEYEAREWDKKFRELE

SEQ ID NO: 233001 - protein, 112 aa, Glycine max
  Coding DNA Sequence Number=SeqID_116223
MADTVDKNEVNLCFESNTSSSASSDDEKDMPYDHVDNGCSWHMTGEMFMFLDLKSLEGGAVAFGNIVKRILRYLKRTFSWDLHLKPASTPFSINAFNDAYWASDPNDKKPTS

SEQ ID NO: 233002 - protein, 134 aa, Glycine max
  Coding DNA Sequence Number=SeqID_116224
  Gene Ontology: Mol. function=RNA-directed DNA polymerase activity; Cellular component=chromatin; Biological process=RNA-dependent DNA replication
MALMGSKSNFGNIRFPHPNLVETRYQIYLGINLGAMKFIYQFTNGRNQILIQNCDPIQSSEVDAHPLGLILFLDENNRIGKRAYRIADDVIIKKFSHLFLDLIFMVEKHEESSWRRVVSTIATPCKRPYKVGER

SEQ ID NO: 233003 - protein, 101 aa, Glycine max
  Coding DNA Sequence Number=SeqID_116225
  Homolog annotation: Hit_ID=Q9SGH9; Match level="QueryCoverage=42%, HitCoverage=4%, E-value=5e-12, Identity=62%"; Hit description =Putative phosphatidylinositolglycan class N short form
MVPSKLKGMFYHIAIRLLHEIIVEREAWGDGATIKIKKASQVICCKAPQKMGTILGLPKEMLCWLLLNMELNSTGLVFHPTRKGNHPSNLGLRPNSNRLLR

SEQ ID NO: 233004 - protein, 86 aa, Glycine max
  Coding DNA Sequence Number=SeqID_116226
  Homolog annotation: Hit_ID=Q1T2D5; Match level="QueryCoverage=97%, HitCoverage=5%, E-value=5e-10, Identity=42%"; Hit description=Chromo
MALEMRFAPSFYDNPRRALPKLSQHGTVNSYLSEFKSLANRIVGLPPSCLLSCFFSCLSPEIRREVQALQPLSHVQAAALAKLQED

SEQ ID NO: 233005 - protein, 214 aa, Glycine max
  Coding DNA Sequence Number=SeqID_116227
MTGILLFLKEQHILKGRHNDTRCFQSLEAWNRYTDNILGRNIIPKRNVKIYHTEFDKFKVLLERRNLHKRLTKLQDGSIDMAVVKEFYANLYSPEEPAPKQARVRGHLIKIDADNLNEFLQIPVGQPWKLLRKDLKTLAQTWNVFSYSNLAPTSNTSDLNMDRARLVYGLVSNMDMNIGALISALITALCKARGFTSNSLTYESLSPDINLAYI

SEQ ID NO: 233006 - protein, 79 aa, Glycine max
  Coding DNA Sequence Number=SeqID_116228
MNVLSVLVALSLFIAAVKFLDFQMITLSGPCRAKRAKRALCAKPKGHSGEAELSPTCYAKPIPSSVLKMARRESAALSP

SEQ ID NO: 233007 - protein, 86 aa, Glycine max
  Coding DNA Sequence Number=SeqID_116229
  Subcellular localization annotation: CTP_CleavageSite=42; ConfidenceScore=5.22e-01
MKNLGTLIARKKNSASGLAQHLAQRKARAKREGSSHTKRATRAKHANQNNGAKREQLAKREIQHALSERSALSKLTMVQVHFSSYK

SEQ ID NO: 233008 - protein, 39 aa, Glycine max; identical to SEQ ID NO: 157191
  Coding DNA Sequence Number=SeqID_116230

SEQ ID NO: 233009 - protein, 99 aa, Glycine max
  Coding DNA Sequence Number=SeqID_116231
MKNWMQNSKKDVYLGAYLNGAHWQIVIILPKENLVIWFCSLHNRPNNYLKGIINMLVLFFNTFALALVGNINFLIVQYASMFVLNNALKGLDDTPQSKS

SEQ ID NO: 233010 - protein, 202 aa, Glycine max
  Coding DNA Sequence Number=SeqID_116232
  Homolog annotation: Hit_ID=Q1S8H3; Match level="QueryCoverage=87%, HitCoverage=43%, E-value=2e-25, Identity=42%"; Hit description=RNA -binding protein Lupus La
  Subcellular localization annotation: CTP_CleavageSite=44; ConfidenceScore=5.69e-01
MVTAAKSSNHHSPPSAPSPAQPGDGNSPKFPRKNLPSPWAQVVRGGEPESAGGIHQSPPSSSSSSSSSLVADQAPSSEVIPVSSPVDNSNTVGDVDSSDGAEGNADCSKKPVWNKPSNGVVVVETGPVMGAAESWPTLLASTKGSAKLPAESSSKTVTDDGSLSTSQWPMTSQSPQKQATTIAKPSSAPNYNVPSRQRSMKR

SEQ ID NO: 233011 - protein, 131 aa, Glycine max
  Coding DNA Sequence Number=SeqID_116233
MNYAPFIIQEQQVGWHSKLGGKTRRDRFNTLCHSDFASRVINAQRQVCALCHSGTVSREVGGDKLWSFRAPFRHPEAIVSGGMQRQINGHSVSRCPGSIVSNKTQRQIMVIQRLVSTERNKFDSIRMMCRY

SEQ ID NO: 233012 - protein, 88 aa, Glycine max
  Coding DNA Sequence Number=SeqID_116234
MTTTKNTTVTMPFRSTKYENDDGIVTHTKMTQYTINSKLGCVSLWSSSTGMNVWWSSLWLGNLATNYFWKQGCRSVGDEALSGTRLWK

SEQ ID NO: 233013 - protein, 267 aa, Glycine max
  Coding DNA Sequence Number=SeqID_116235
MKRKCMYTLENVDPMGGPVSEIGPVIKVHAMPINCSAENVVETVTEECTQNGIEDMDDDGAKGGSDDENEVVGLGVQDVETEVVETTVETEPEVVGVETEVNSDADDDEVKERDGDVDFFYHFESDLDYVYVSPEDDGQSSDTLADSYQSKEFQSLPNSDDEGDSNSKIMYPQYNPTNSFGQVHLEVGMEFDTIKMFIEVVRDFTIFHGRDLKWVKVDTIRAKARCKQVGCSWEIYCSWSEVTKAFKSRLFWRSTYVEGSSKINKLQ

SEQ ID NO: 233014 - protein, 106 aa, Glycine max
  Coding DNA Sequence Number=SeqID_116236
  Gene Ontology: Mol. function=DNA binding; Cellular component=nucleus; Biological process=regulation of transcription
  Homolog annotation: Hit_ID=Q84QS1; Match level="QueryCoverage=67%, HitCoverage=24%, E-value=5e-26, Identity=75%"; Hit description =Transcription factor GT-3b
MEGHHLHHRQQQLQQHHHPHHNITTSNVDATDRFPQWSIQETKEFLVIRAELDQTFMETKRNKQLWEVISNRMKEKGFHRSAEQCKCKWKNLVTRYKFETEIIKCL

SEQ ID NO: 233015 - protein, 136 aa, Glycine max
  Coding DNA Sequence Number=SeqID_116237
  Gene Ontology: Mol. function=drug transporter activity; Cellular component=membrane; Biological process=multidrug transport
  Homolog annotation: Hit_ID=Q1T297; Match level="QueryCoverage=53%, HitCoverage=21%, E-value=4e-17, Identity=64%"; Hit description=Multi antimicrobial extrusion protein MatE
MILCFNDHHETSIPNPHSLLSTPLPSDLDLQRSTVLLTLASILQSSNRLCFFSEHILIFLGEPPRITSATVLFVYGLIPQIFTNVVNFPIQKFLEAWSIVAPNLSKSDSEADIARQRGGVLAAGDNDQRECRRTND

SEQ ID NO: 233016 - protein, 367 aa, Glycine max
  Coding DNA Sequence Number=SeqID_116238
MWPTLGQSPKGLGNQLDQEVLVVLTSSLDILGFTSSGSFTLSSHSSTFSWDDKDEDQYGLKEVVNESMEVVSGKRVDVRVSCTDNVESVLQLKCRAITKKDKPPPITLLSYLWVDDKVGTYFILYSDNLSILHFINYARVCPFVDDDFSPIHLCACRNDTFANPNWVFLAKEKSMRGDRSSIGETTNVSMRYDDFPEDNLTNTKKCNLTILATLPLSFPTKPIITLYKSSIVMKDLRDIVRLVGMDALNCVSVCIEVRVIAANAIVTGPASWAKNLKRKKDSIVALKSKMYTLKGPLTKAKKENPKNVEFDIFKDVHERTLISIQDIHKKTPRTSWPLTPPVKTQMTNANTNMGDTKVNDKDEVIDN

SEQ ID NO: 233017 - protein, 229 aa, Glycine max
  Coding DNA Sequence Number=SeqID_116239
  Subcellular localization annotation: CTP_CleavageSite=32; ConfidenceScore=5.09e-01
MDWEVISISGSSLEDTHRGASNSESSSLERIRVSRRTSGGTFHPCRRVRPFVTATKPILVTMILPPSTSWGVGKGFGSRDAKASPHMDDVLKHKSSLTSTVSVVALQHQCTLLEHLNVAPSQLHPNSWAMCAKKLFEFDSNIFSHFKGHFFKVLSTDVMADGIPLMFNRDEEPRFPFYWQFDPTRLKSYDEDLLTLVEKVNKAILEQLPGSLDAWAILSLPSASDRSLP

SEQ ID NO: 233018 - protein, 449 aa, Glycine max
  Coding DNA Sequence Number=SeqID_116240
  Homolog annotation: Hit_ID=Q2HUH8; Match level="QueryCoverage=27%, HitCoverage=31%, E-value=1e-13, Identity=37%"; Hit description =Histidine triad (HIT) protein; Homeodomain-like
MSITDNMIEVVQTTLVQARGLDKPHRFAILSLVEVTTPDTGNHLSTLGGSKNSSPSTYQDYYPRHQTNSLNMGQTLSTPDNLFFPQANSELGGLMDRVLALRVIEGLVGGIVRLAKVKCGALCRGGGWRGREAVEGKRKEKGGEKMSQEEVHHYRKPWIRAWSPLIQDQVQDSPLSVLRGPEGKEGERGKGGYGGEGDCDEGKSEKINRGEGEEDTHLIGLWLNVSMDLIVGDVQGHYKQSVDLKKNGYTEIDVMVHTYSIWKEDEGSNFTLENAWRLLKNQPKRSDQIKETSSKRTKISTKGNYTPSSNSKKPIEAIESDTPSQIPRPMGQKSAKRKMKGKGATMSSPIVDLMSMEAVIREKSEATKKVVEAKVKEREKVLYEILMKDTSTISEEQHKKHEVSCTPLTRKIDPNSDFDRIWKEIVDEILEYNTEEEIMRYLHEVQQQA

SEQ ID NO: 233019 - protein, 69 aa, Glycine max
  Coding DNA Sequence Number=SeqID_116241
  Subcellular localization annotation: CTP_CleavageSite=42; ConfidenceScore=5.33e-01
MKYCKTTSGEEVSFTSRISQSLTNSSQALKSAPASSSGGLVRARALSARMDRLAHVSDFWLSAPFLLRG

SEQ ID NO: 233020 - protein, 355 aa, Glycine max
  Coding DNA Sequence Number=SeqID_116242
MTNTCIMDDFAYRPFVKQVGPGGRDVPPSTVVAVVEKEGQPASEVGHIVVDVEVTPNGSSSVLAKRKRDVPLAPSAVEATATATSAPAPSPSSIIVVQEVTIVAIEVFIPATLASSLAALPSTVISFGVVTTSAPTVLPYSSNPSVASASTILAAVASPSSFSHPRVSLDHFYKSKQKTSVGFVSAFDKNLIRSAGVENATDSAKVFLQRSLAILEKSEQRHQEAVQKVASLEAEVAKWRTTTRTLWRVERPKVANATVAFAKAVRLNYQYLSKLVAYWPKLLLYKKEVVEQHEKGFLEAVKQADFFVKDLNLGLFNPFKDVKDGIMLDEEGIIADDEAIDEGQGVVKQGDDACV

SEQ ID NO: 233021 - protein, 83 aa, Glycine max
  Coding DNA Sequence Number=SeqID_116243
MGEERRKTVKEEVDKLLKENFIREVRRYIPTTDGLSLQTTNWTKRRGKDKFPDFMITHRGIEANPDKCTAILEMRNPNYIQEV

SEQ ID NO: 233022 - protein, 118 aa, Glycine max
  Coding DNA Sequence Number=SeqID_116244
MTLVVSDMYWRRYGVLLHTCLLQSGMYWRHGGVNQWDSLRVDLGFCQPFGGLTRESSDLGFGHRALPHMSLVVGGTHWRHGDKLLHICHSSWVAYTGVVMAIRSCMYVTRCGWHTPES

SEQ ID NO: 233023 - protein, 92 aa, Glycine max
  Coding DNA Sequence Number=SeqID_116245
MGCSKQMLTSSHGPKIYPKAHENPRAFSYISGSIFLESSIQCPWGVVLHQDTPLEVAEEGVSSTAEADIDDDYVADVTVVWDLGSMAHSSSG

SEQ ID NO: 233024 - protein, 214 aa, Glycine max
  Coding DNA Sequence Number=SeqID_116246
  Gene Ontology: Mol. function=histone-lysine N-methyltransferase activity; Cellular component=nucleus; Biological process =multicellular organismal development
  Homolog annotation: Hit_ID=O04479; Match level="QueryCoverage=93%, HitCoverage=92%, E-value=6e-54, Identity=57%"; Hit description=LOB domain-containing protein 6
  Pfam annotation: Domain name=DUF260; Domain location=7-107; Score =228.1; E_value=2e-65; Accession=PF03195.5; Description=Protein of unknown function DUF260
MASSNPPCAACKFLRRKCQPECVFAPYFPPDQPQRFVNVHRIFGASNVSKLLNELHPHQREDAVNSLAYEAEMRLRDPVNGCVGIISLLHQQLRQLHMDLQSAKFELSRIHNLGVTIPTGYGHTSAAVITPVSASHVMNGADGSYDNRYYNQQHSYHQCVPQQLVRNFVGAGNNCDEGNVLAINIASFGPLSQLQQPSAAAVARDDPHTRVHHS

SEQ ID NO: 233025 - protein, 2097 aa, Glycine max
  Coding DNA Sequence Number=SeqID_116247
  Gene Ontology: Mol. function=protein binding; Biological process =defense response
  Homolog annotation: Hit_ID=Q1SPY2; Match level="QueryCoverage=96%, HitCoverage=98%, E-value=0.0, Identity=58%"; Hit description=Disease resistance protein; AAA ATPase; Zinc finger, C2H2-type
  Pfam annotation: Domain name=LRR_1; Domain location=1023-1046; Score =0.5; E_value=2.2e+02; Accession=PF00560.23; Description=Leucine Rich Repeat
  Pfam annotation: Domain name=LRR_1; Domain location=1051-1070; Score =3.5; E_value=64; Accession=PF00560.23; Description=Leucine Rich Repeat
  Pfam annotation: Domain name=LRR_1; Domain location=1077-1101; Score =4.1; E_value=49; Accession=PF00560.23; Description=Leucine Rich Repeat
  Pfam annotation: Domain name=LRR_1; Domain location=1108-1132; Score =3.8; E_value=55; Accession=PF00560.23; Description=Leucine Rich Repeat
  Pfam annotation: Domain name=LRR_1; Domain location=1134-1155; Score =5.8; E_value=24; Accession=PF00560.23; Description=Leucine Rich Repeat
  Pfam annotation: Domain name=LRR_1; Domain location=1312-1332; Score =1.4; E_value=1.6e+02; Accession=PF00560.23; Description=Leucine Rich Repeat
  Pfam annotation: Domain name=LRR_1; Domain location=1371-1394; Score =5.7; E_value=25; Accession=PF00560.23; Description=Leucine Rich Repeat
  Pfam annotation: Domain name=LRR_1; Domain location=1434-1461; Score =4.0; E_value=52; Accession=PF00560.23; Description=Leucine Rich Repeat
  Pfam annotation: Domain name=LRR_1; Domain location=518-541; Score =1.8; E_value=1.3e+02; Accession=PF00560.23; Description=Leucine Rich Repeat
  Pfam annotation: Domain name=LRR_1; Domain location=588-610; Score =7.1; E_value=14; Accession=PF00560.23; Description=Leucine Rich Repeat
  Pfam annotation: Domain name=LRR_1; Domain location=612-634; Score =6.0; E_value=22; Accession=PF00560.23; Description=Leucine Rich Repeat
  Pfam annotation: Domain name=LRR_1; Domain location=695-716; Score =5.4; E_value=27; Accession=PF00560.23; Description=Leucine Rich Repeat
  Pfam annotation: Domain name=LRR_1; Domain location=800-824; Score =5.9; E_value=23; Accession=PF00560.23; Description=Leucine Rich Repeat
  Pfam annotation: Domain name=LRR_1; Domain location=861-885; Score =2.1; E_value=1.1e+02; Accession=PF00560.23; Description=Leucine Rich Repeat
  Pfam annotation: Domain name=LRR_1; Domain location=952-975; Score =0.0; E_value=2.8e+02; Accession=PF00560.23; Description=Leucine Rich Repeat
  Pfam annotation: Domain name=LRR_1; Domain location=991-1011; Score =4.6; E_value=39; Accession=PF00560.23; Description=Leucine Rich Repeat
  Pfam annotation: Domain name=NACHT; Domain location=174-324; Score= -20.9; E_value=0.0024; Accession=PF05729.3; Description=NACHT domain
  Pfam annotation: Domain name=NB-ARC; Domain location=136-437; Score =226.7; E_value=5e-65; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::NACHT::NB-ARC; Domain location=1023 -1046::1051-1070::1077-1101::...
  Pfam module annotation: Domain location=1108-1132::1134-1155::1312 -1332::1371-1394::1434-1461::518-541::588-610::612-634::695-716::800 -824::861-885::952-975::991-1011::174-324::136-437
MEFLYGFASSISRDLVCGAVNQLRYPCCFNNFVEELEKEEGYLIATIDSVQNRFELAKKQTRKVAEVGDKWLKDANIDANKVNQLLKEARTKKSSCFGHCPNWIWRYQLGKKLANRKRKLEKCIEEGRQYVEIESIATLPFGTHDFLSEKSLTFESRQPAYEQLMEALKDDEVAVIGLYGMGGCGKTTLAMEVRKKVEAERLFDEVLFVPVSSTVQVQRIQEKIASSMQYIFPENEEMERAQRLYTRLTQDNRILVILDDVWEKLDFGAIGIPSTEHHKGCKILITTRSEEVCTMMDCHKKIHLPILTDGEAWNLFQKKALVSEGASDTLKHLAREISDKCKGLPVAIAAVASSLKGKAEEVWSVTLMRFTSSKPVNIGKGLQNPYTCLQLSYDNLDSEEAKSLFLLCSVFPEDSHIPIELLTRFAIGLGFVGEVCSYEEARNEVIVAKIKLTSSCLLLCVDDKRVKMHDLVRYVARRIAKNENKMIECALEKDATLEHNSVRYLCSKKIPDELDCSNLEFLYLYTNLDVSDGIFKGMRMLRVLFLCNKDRYRRPLLSMSLKSSTNLRCVLLRNWELGDISFLGDVKKLESLTLHNCSFLELPDVVATQLTSLRLLDLSECDMKHSPFEVIGRLPQLEELYFADHRSKWDFYNEHAAEFFQEFRVPQALQRYHIQLGNMFAGFQEEFLNRHRTLFLSYLDLSNAAFKDLAKKAEVLCLANIEGGAKNILPDIFQIEGGMSHLIELLIRDSEKIECLIDTSHHLSEVGAIFSNLHCLRIERMKHMGALYHGSLPPRCHFEKLKDLYLSHCPKLICLFTLEVAQNLVQLEKLEIISCPGLKHIVTDDDKEEISTNDKRLLFRKLKRLHVRECDKLKYLIPITFAHGLVQLENLEIVSNSELKYLFGHCTKGDHLAGQNQNELKIELTALEELTLIMLPEIISICPEVCYPTWPLLRQFTLQNCPGFSIVSINTCLAFHNNDIINEASYLTVQNIKEVRVNNCELEGIMQLAELSIDGKQDPLISCLEMLYLENLPQLRYICKGDKKSLNLLQNLQQMEVSGCRKLKSIFSACISGGLPQLKELKIENCSQLQQIIEDKEPQNPGSFNLPNLTRLTLKSCPILGSLFSASTAETLTSLEELTIEDCHGLKHIQIYGRAHTNKKEVIQDDHDFQSYVPFFPSLKKLSIMRCHLLEYVFSISFARGMRKLEIIEIREAPELRHVFGQNIHSSQQYQSKFQIEFPVLERVTLHSTPNMIGIFPENYSATCSSLQLLVMNNIGLSTLSINNLKVDLEATHSDHSSKTDSRVMSMTTKQKLASVIIENSEIKEIFNLEGFPINGQQMTLWIQVLELVNLPKLRYIWKSSKHFVCLQVQHLHELHICNCPKLKVIFSVSILRMLPLLKILIVKHCEELEQIIEDDKENGNGSNPQSPKVCFSHLKLLLVSHCNNLKHLFLISIYHEFPELEHLILNQNTRLVQVFQGETGVREGRVEVLLPKLKHVVLMQQPNLINLCDGIEFQTVINLLVHDCPKFSLTSTTTVEDMLRTSNSVPLHLVLDPFINYLTHFTFNKEIDFYLRPQLLNISGITTKGFDVLTSKKENKGTKDLQSWDQRLPLIPIPNLMKSIEDVVKDWIQEEAPSEEVKKETLSIGVEGAGLDGVVVAHTKPSGAEMVSDFWVVEQGDRPNQHRRGTSSCQRIQNLDDSIQEESNLLDKEGEVGVVSKNSIVAQRNEKPEMEIASEKPAIVNSLTNLELVEGASLSYLDIPLHKTHSNGLVDGQSMSEPFYMNQQKLLGEIASTVEIPQSEIMPSQTETYTAKESEGHTINILDFVANDLMSLFQPVEYDGEGHVTEDNQVVKVLADLERCLKMPLKDIASSETDSLLLLTALNFLSNLPLKDVTLSDGLKDIVDSMHTQFPSILCSFKQAFATTDKLEAHEAHQNVVAVTLASKISGAKNFMDEGQQKEAVLKERITRLKKEIKDCEADLSSLQEEKKKCIAETIRYKEEFENVRKEKSQMVEDQRKVRQELFEVRQIRCASVGHLLTTSMRLIAEKEKNKILQILIASMLGKDHKQQQQQQRQQQQQQVKAKWITFPSVQIMIGS

SEQ ID NO: 233026 - protein, 304 aa, Glycine max
  Coding DNA Sequence Number=SeqID_116248
MASKKRRISSSKHQEPYGTSRFVSEVTWEQYEMNIHNRNILPERNMELAYSHYDEFLRELERCQWHMNLTRQMENHIDLVLVKEFYSNLYDPKDRSPRQCKVRGKTIKFDAAILNTFLETHVVFEPRGAPWKLLRKDLTTLAQTWSVFPYSNLAPTSHTYDLNMDRARLVYGLVIKMDMDQGSIISEQISHMTQSNSSRLGFPALITALCIARGVVSDSLTFESLSLTINLTYIRKNCWNPKDPSITFPGSRKASARAPSNALASTPAPAPVPSCGACRPWIFFTNKVICFLKFNGSGMKKEER

SEQ ID NO: 233027 - protein, 35 aa, Glycine max
  Coding DNA Sequence Number=SeqID_116249
MAKLKEGNVGATSEIFQDIADYYHNLCLTCYYMMS

SEQ ID NO: 233028 - protein, 37 aa, Glycine max
  Coding DNA Sequence Number=SeqID_116250
MQSLVTKKPSTRSRQLNHAFEPEYRVAPPSKSQTKFY

SEQ ID NO: 233029 - protein, 121 aa, Glycine max
  Coding DNA Sequence Number=SeqID_116251
MSMPPTPELPIALRKVKVVPDDSIDLFKAGLVAKGYNTNENMFSLWILNLVQNLKWKHVSAYKINNENVFSHIKPTTESQFCCSRKTEERKGEEGEAVRFELRGTNNKGGRGNNNSPKLFT

SEQ ID NO: 233030 - protein, 165 aa, Glycine max
  Coding DNA Sequence Number=SeqID_116252
METKYERGFSLYTPHSGVTRTDVPILILLPQIKLFFVKPVGFMERKRKDGERKIHYRKSKVSLIHGGLYQDVKTNTTGQRESLFKKAVLSRVNSRFILASHRMEDILGEITGFHIPEHQLTVGLTPLICACQAYPAARENKKISLIQEDLYQDAKTNATDALANK

SEQ ID NO: 233031 - protein, 817 aa, Glycine max
  Coding DNA Sequence Number=SeqID_116253
MAMTKKISMQYQGKKVFHCSLRLSSDVDSLFCLNQDMNESHDVVEPSEVLSLQPFQPTDFIENMHSMMDPLTCEQDVLATFIPETVEKGASKSLIDTIDSVGQQKEGSEVKDFEGADVSNAVKLSIAASEALVIHDLVKMDSVLETMRTEAVLEVALRVKQARLEGLEDGFQSSNEESNYSDSLSDLDDFIMEDTYEDIGLPIDVPVENNLCSSTIFQVKGVSGAENDSRCNNKHSDGELTSQLANFDDKSKQKQLEANVEREVQQDSPRYSLHCEKEMHSDDPGLGENTLKHFDDNLRISHQCIKYSTDVLAPNQTVGLTMVGLTSIKPPNSVNLPLVENSGNFINSSQNDVKKKELDSSSLNQNNAKWIPKILVRETSFLTESVDIVPDENSFVLKHHPKCSIGSQLSVPSEDSHNKRDEGILQSQDVIRCSSLSLTDPLCSVVPCSLSLEHVNYNTDIDKKNDTKDFVPSISEFEVDNFQSILDKNVKFGCSDEKIMSISDGKDIPITETMMDEQITGKLTRIEHTCLKTYSMIIPNQDFNLKYNLDELPTDQSMGSAASLGTKISQSQSASKHADENKNKEDNQPLVDHKSTLEITDDKSGNELKAADASDISTEPTQNRRSPLILNHRIRRCLQGPMNVANGISVEKIMTQHVVPEAVAQNRQNNNLNKLQLESNNVHSGHVRVRKQVHFSEKVEELHPKRKCSKLESSHKRCSSVRAKRGRVSKSLTTSVPCMKHSLTNYCRSAVNEFIFQGIEFLLTGISSQKERNMEALIRNSGGVVLYDIPSPQNSGGKRNSTLYHFPIILCMRKVCF

SEQ ID NO: 233032 - protein, 249 aa, Glycine max
  Coding DNA Sequence Number=SeqID_116254
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q9LUZ6; Match level="QueryCoverage=92%, HitCoverage=57%, E-value=7e-96, Identity=62%"; Hit description =Arabidopsis thaliana genomic DNA, chromosome 5, P1 clone:MZN1
  Pfam annotation: Domain name=DUF231; Domain location=172-248; Score= -30.5; E_value=3.6e-05; Accession=PF03005.6; Description=Arabidopsis proteins of unknown function
MIHANQTNCALFVGTWVQDDSYPIYQSSNCPIIDPQFNCKMFGRPDSDYLRYRWRPLNCDLPRFNGVEFLLQMKGKTVMFVGDSLGRNQWQSLICMIYAAVPQTQTQLVRGEPLSTFRFLDYGVTISFYRAPYLVEIDVVQGKRILRLEEVDGNGDVWRSVDVLSFNTGHWWDHQGSLQGWDYMELGGKYYQDMDRLAALERGMKTWANWVDSNVDRSRTKVFFLGISPSHTNISKPDTFAFLDLDSLP

SEQ ID NO: 233033 - protein, 243 aa, Glycine max
  Coding DNA Sequence Number=SeqID_116255
MMLLKVLADSLLYWIYEHFPSVHESVTDKGYDETSPCACRWLTTKAYSKGFAASTYQTCIDALTIPDGKLRWGPIVVTHRPVVHQFVYIHTIPPLPIGATLSFKDMDGRWMHYSDHLVAAGQICLVPGQCVADYMDLFFGISHSFITPTQSTDSPKHPPVPQHETYVEPDIPEVPVAPKAGPSESVDQPRHAVDACEAIAERLEHVLNLRMVTVGTELHDIMEDYQRIARGVTLDGNMYVRVR

SEQ ID NO: 233034 - protein, 70 aa, Glycine max
  Coding DNA Sequence Number=SeqID_116256
MKSWFHIAKNVKAKCKSLIGQKNAWEYVMDAGNSLVDCPSEQVESAHWDLKRVLHNSPGDLCSVWDAMTT

SEQ ID NO: 233035 - protein, 154 aa, Glycine max
  Coding DNA Sequence Number=SeqID_116257
QGILGAAPSKPKDDKGKTIEKQPPKAIIYSSQDEATTSHSSSESEEAKWEESSEEIYPQEERQPLMVKEECKEASVSFKRLAKKESHFAIKTNIKETSPLRQPPHLFLCKKTLVSTAMPLGLEVIPQVKELLDEVSEEPCFLMGRCPGKGFSDT

SEQ ID NO: 233036 - protein, 219 aa, Glycine max
  Coding DNA Sequence Number=SeqID_116258
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=32%, HitCoverage=22%, E-value=4e-10, Identity=47%"; Hit description =Similarity to MADS-box DNA-binding protein
MVQQAYWNLEELLMVGQETLRKLSGLVGKEYAPSKKNAALGLKISTSLILASYLSGGLLNKFGEINTLCDIQACAIIYTPNEPEAKVWPSDQGVNSVISRFMGAFELAISKIMLCQENHLKRNINKAQGQLKKLRNENKKKEIDLFTCQYFADVTLLADKNLEITKKNEILQVQEVTLAIENGGETKTEEKQALVANVDAMPNLNGLMTTMRMIGMGSM

SEQ ID NO: 233037 - protein, 45 aa, Glycine max
  Coding DNA Sequence Number=SeqID_116259
MPNGVVLSSEVAFYNAVGRVNRIPGGPGRSHRDHRLFRLVYRHVM

SEQ ID NO: 233038 - protein, 85 aa, Glycine max
  Coding DNA Sequence Number=SeqID_116260
MAPILLCYFVLNAWFCHCGPVSLVGGCFANIERGSSSVELARSVAHENGFVAVIMRKKEFVRRDTESQKCDCPFKLREKPVIGGQ

SEQ ID NO: 233039 - protein, 79 aa, Glycine max
  Coding DNA Sequence Number=SeqID_116261
MEVDLRRSGLAAARGKSFGQQGHQPPLGDESLVDRDDALEITCQKSDQAALNVGASPHSGGQENGTQGWMHEFYCPYKK

SEQ ID NO: 233040 - protein, 278 aa, Glycine max
  Coding DNA Sequence Number=SeqID_116262
  Homolog annotation: Hit_ID=Q10F72; Match level="QueryCoverage=59%, HitCoverage=48%, E-value=3e-29, Identity=90%"; Hit description =Expressed protein
MAFTLSFNDLYQVVTFWEGEIVDTKNYTFFTGKWEASPEDDIRHWSKFPSFSPLLGQVEADGGKSLDLSNYPYIFMRLFAMRRYGGGILCAALPLHMQRGCFRIRTHDQQVTKAQLYRCTRARPHQEKMIMLKKKRWKEQYFVNVGTDCGLTIAGFYYICFSCSDGSISGFYYDPNSRARKMDLTWWARLASLQVGPGWALKKIMVRTKGLGRTLGRIIGRALGDKLVVMRMNPPSSEGLQHLHIDSEKLHLLLRMFSMWIMQMMRSMNSLKKQLLMM

SEQ ID NO: 233041 - protein, 177 aa, Glycine max
  Coding DNA Sequence Number=SeqID_116263
  Homolog annotation: Hit_ID=Q40538; Match level="QueryCoverage=20%, HitCoverage=64%, E-value=1e-07, Identity=86%"; Hit description =Nicotiana tabacum (clone 5) activating factor DNA sequence
MKENIMSTPHTGRRATRITAAVLTGLCAISMSACAGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 233042 - protein, 71 aa, Glycine max
  Coding DNA Sequence Number=SeqID_116264
MGREKTHVRPLTNLFNLKGETQRVVSQPTLRREGDAKLTGASSKKGIRAESPPTFIRGKRRKNRKDVAYEL

SEQ ID NO: 233043 - protein, 88 aa, Glycine max
  Coding DNA Sequence Number=SeqID_116265
MLGYEKGITLLKNQKGNGVAESAHVELLPKAQAHLPYAYERKRGMLLAAVWGERSKIRVTQKSNRRSGSANSHAGIIELLGDKIELRT

SEQ ID NO: 233044 - protein, 116 aa, Glycine max
  Coding DNA Sequence Number=SeqID_116266
MTRDEYACVKSMTNHNKKYVVGSCCNLPFGGGTKRPRSWAKAFVSEGENERSHHQRLFEENVRKTKKMMTLEPLPSLPSCLFIAKQGIWDEGSSPWQAELTQASCYFILKQPCLPW

SEQ ID NO: 233045 - protein, 1264 aa, Glycine max
  Coding DNA Sequence Number=SeqID_116267
  Gene Ontology: Mol. function=RNA-directed DNA polymerase activity; Cellular component=chromatin; Biological process=chromatin assembly or disassembly
  Pfam annotation: Domain name=Chromo; Domain location=1109-1159; Score= 31.6; E_value=2.7e-06; Accession=PF00385.14; Description='chromo' (CHRromatin Organisation MOdifier
  Pfam annotation: Domain name=RVP_2; Domain location=143-258; Score= -36.8; E_value=0.00073; Accession=PF08284.2; Description=Retroviral aspartyl protease
  Pfam annotation: Domain name=rve; Domain location=831-992; Score =50.3; E_value=6.3e-12; Accession=PF00665.16; Description=Integrase core domain
  Pfam module annotation: Pfam domain module=Chromo::RVP_2::RVT_1::rve; Domain location=1109-1159::143-258::390-559::831-992
MTYEDPTGLLCKLKQRSSVAAYLSKFEALANKIIGLLAPFEEKLLDARRSSTYRALPSTAGSATTRSSSTNTTPPLLPTPTRNSSSIPFKRLTPEELASRREKGLCFQCDEKFSRGHKCQSSLFLLVMEDEKEVEDIELLSLHALSGHLAPETLRLRGLVNNQPISILIDGGSTHNFLHNRVVMRLGLTPTETTSLRVTVGNGDEIRCHQLCTVVQVHIQQQLFTIDFHVLPLCGADVVLGVQWLKTLGPVLTDYGALTMKFIVNGKLIELKGDREKECEQVSPSQLRRFVHTNPASTFFHIRIEATTKTKPQMVHPIPEIETLLTSYASLFQPLATLPPSRATDHTINLLPNSIPVNVRPYKYPYFQKKEIEEQVAAMLARGLIQPSSSPFSSPVLLVRKKDDSWRFCVDYRALNAITVRDRFSIPTVDELLDELGGTRWFSKLDLTQGYHQILMNPNDISKTAFRTHQGHYEFRVMPFGLCNTPSSFQATMNQLFQPYLRKYIIVFFDDILIYNKTIHDHLLHLEKAFQVLMARQFSLKRSKCTFAQQQLEYLGHMVAGHGVTPVPEKVQAIQQWPTPRSPRALRGFLGLAGFYRKFIQGYAMLAAPLTRLLCQGQFDWNQEATNSFQNLKKALTAAPVLALPDFSVPFVVEADVSGAGMGAVLMQKGHPFAYFSKQFCPRLLNSSMYVHELAAIITAHWYLARLLGYDYTIQYRVGKANIVADALSRSMETASIYLLSVPCFVFLEDLHKELASLPAFLALRDSILKEPEGRIWLPPTSSFIHLLLEEFHQSPMGGTWAFKKRYNVSRITSYGPRTRRIRRILWRHASPVNSLNTITARLQGFSVPSPFRHCPGNTCIFVVVDRFSKGLHLGMLPLQHTAHTVALLFIDMVGHLHGMPKSIISDRDPLFVSKFWRELFTLSGTKLRLSSAYHPQSDGQTEVANRIVEQYLRAFVHEKPATWDDTYPGPNGRTIRRATPPQECHPLELLSARNRPRIPNISQERMKTSVDRHRREQEFMVGDWVMVKLRPRRQTSVTGTTYSKLGKRYYGPFRVIERMEKVAYKLQLPKYSRIHPVFHVSLLKPAVAPTTADTVDLPPLTTDNHPVVMPLAIVASKIVPSETRPKHMVLVQWRGLPLEETSWEDWSVLKTIHHLEDKVFLEGQWSAMRGGDEGVPSAKENEARDKCEGSEISLRRERTNLVVILLEGQSQVSVIQDGLSWFMGFSGANEGNPQISAKKSYGLYEYMAKRFVLNFKGKMLGSF

SEQ ID NO: 233046 - protein, 70 aa, Glycine max
  Coding DNA Sequence Number=SeqID_116268
MVNESTTVILAFEGQGTSRTEKEKEVSKGILFMIHVLNYKYAGMNLARNGLARATSCTSLADGTPQHLLS

SEQ ID NO: 233047 - protein, 89 aa, Glycine max
  Coding DNA Sequence Number=SeqID_116269
  Homolog annotation: Hit_ID=Q5NB82; Match level="QueryCoverage=78%, HitCoverage=8%, E-value=3e-10, Identity=55%"; Hit description=Nodule inception protein-like
  Pfam annotation: Domain name=PB1; Domain location=19-77; Score=14.1; E_value=0.0089; Accession=PF00564.15; Description=PB1 domain
MDNLNNTLTPFVVRKEVRSMTIKATYKEDIIRFKVSMDCGIVELKEEIAKRLKLKVGTFDIKYMDRGGPPRVHGHLKIIRQQHNQACGA

SEQ ID NO: 233048 - protein, 127 aa, Glycine max
  Coding DNA Sequence Number=SeqID_116270
MAESTCSKTSVDHLKDAIAKLIASQFAMNSKIDDLLHRMSQLEAHQQQPQPLTPPSSSTSHTPSHNLQHRMKLDVPRFDGSDPTGWIFKITQFFEYHATPEQERLTIASFYMEGPALAWFQWMHRNA

SEQ ID NO: 233049 - protein, 279 aa, Glycine max
  Coding DNA Sequence Number=SeqID_116271
MTREAEVTNDFDQSLKQKHRGAIIPWLIDNNVVALYSLVFCRDANNSGEAGNVTWTLLKTLKKSDTDSWGESDLTWDEVEGLSQKQSKLSEALNVLQREGEMISVATLRIFGKRVAEIPFVATRRRLFCLEVCRVMKKDTNLNSSQLQNNQSIVDATVDCHLSDVPLNPSENIHNPDSYPPTVPSSLVEDEPEFCPEAVDVCRVMKKDTNMNSLQLQNDQSIVDTIVDCHLSDVPLNPSQNIHNLDSFPPTAPSSLVEDVSLLENNYILGVALSKMAIE

SEQ ID NO: 233050 - protein, 85 aa, Glycine max
  Coding DNA Sequence Number=SeqID_116272
MMGDASKFIHISPKNSGHVTYEDNNKAIIAKSRGSERYKWIFLLLVTYKWLSSSKRRRMRIIQVFGDAKVLPKDGCHHQKGGECE

SEQ ID NO: 233051 - protein, 87 aa, Glycine max
  Coding DNA Sequence Number=SeqID_116273
MGAKYLEVVKRWSHPNNGWSPDEIRVKMRLSHEVLKGITLTRAQGTEHHSTPYFGKRALEAERGVAFAKIPRFYKLITIRVSFAMVG

SEQ ID NO: 233052 - protein, 168 aa, Glycine max
  Coding DNA Sequence Number=SeqID_116274
MIDLNQTLKELATPDLVYKPWCIQYPDTEFHGLAGEDPDKHLKECHVVSSTMRPHDIYEDYVTMKAFPVSLDGALMDKTPIVARQLISNFDLGCFDWAYDEFDDYVVACSICAEISSTILFDCYAGIIYLISDSTWVSSVQVVPKKSCIIVVKNQDNGLIPTIVANSW

SEQ ID NO: 233053 - protein, 98 aa, Glycine max
  Coding DNA Sequence Number=SeqID_116275
  Homolog annotation: Hit_ID=Q9FJK3; Match level="QueryCoverage=57%, HitCoverage=17%, E-value=5e-08, Identity=49%"; Hit description =Similarity to MADS-box DNA-binding protein
MTEGEQTLVANVDAMPNLNWSNDNIDDGDGDGIDVKIGRCLLKKVGEITTLCDIQACAIIYTPDEPKAEVWPYDQRVDSVISRFRGVFELAISKRMLC

SEQ ID NO: 233054 - protein, 87 aa, Glycine max
  Coding DNA Sequence Number=SeqID_116276
MERMRRRQPMTEPMVEPTMSSLRALRLMWAWKALLASLLLSRFNASFSPYATNDEKRKKLNDTTSKMRSFFATSMLMSQEERFSRLH

SEQ ID NO: 233055 - protein, 1112 aa, Glycine max
  Coding DNA Sequence Number=SeqID_116277
  Gene Ontology: Mol. function=N-acetyltransferase activity; Biological process=metabolic process
  Homolog annotation: Hit_ID=UPI00001628AD; Match level="QueryCoverage =87%, HitCoverage=82%, E-value=9e-89, Identity=39%"; Hit description =DNA binding / N-acetyltransferase/ RNA binding / protein binding / zinc ion binding
  Pfam annotation: Domain name=Agenet; Domain location=19-99; Score =30.0; E_value=8.1e-06; Accession=PF05641.3; Description=Agenet domain
  Pfam annotation: Domain name=PHD; Domain location=739-782; Score =50.7; E_value=5e-12; Accession=PF00628.19; Description=PHD-finger
  Pfam module annotation: Pfam domain module=Agenet::PHD; Domain location=19-99::739-782
MDMVDNNQNKQRPGFSRKLGVNEKVEVRSVDLGFLGSWHPATVIQCEKLKRHVRYNNVLDDSGVNYLEEAVSVSEALDGDNECYSYSRGSIRPMPPLVEFERGDLKFGLCVDVNYEEAWWEGVIFDDHCDGMEKRSVFFPDLGDEMQVGIHQLRITQDWHEVTGEWEQRGNWVFLDLVEEQKRKSFVAVSAKQIWYDVRIKNGFEKIREWTCNMKYLWRNLVMEVINDYLSLTVNEVILVLNLPWSLLNEAPEPESVEAMASVDLSVTFPDKEIVVQKEPVPPVKEVLPKLQKEIGPCGAFWSEESRENKSSTHLRSHYWKPLKLSEVALCPDAVREYLLAPNRADKALWMEKLQKHLVCLGWKIEWSNKNNIKRYRYNVPDKQGKKFYLSLIEVCRDMEKDPGTNSLQLQNDQSIVDPTVDCHLPDVPLNPSENIQNPDIFPPTISSSLVEDEVEDVPKFCPEAVEQYYRSYISNMSRADKKQWILKAKNHLLAEGWIFDYPPPTNKKRGIIYISPLNRRFPTLHAACRFCMGKSISKLARSDMKHLNVSGMNEENVDQVWSGDLVCRSAGNLVCRSAGNRKRKSLGNSKANIPKCQSNGLALRVLRSKKRAQKVSAPSLINHKPLNVLSYLIDNSIILPRCKVYYKVKGRHRKVCTLADGKITRDGIKCNCCMGIYSFVGFENHASGSSTCRPSARIFLEDGRSLLDCQIKMMHDHKTRETTGKSFSGLSLVENDYICSVCHYGGELILCDKCPSSFHKTCLGLEDIPNGDWFCPSCCCGICGQRKIDGDDEVGQLLPCIQCEHKYHVRCLENGAADISTRYLGNWFCGKDCEKIWHCQGLAYLHHEDQPAILHFYFRRWVSANRRIYEGLHKLLGEPVSVGVDNLTWTLVKFINPDSCEHDSSKSDLLAESYSKLNLAISVMHECFEPLKESLTNRDLVEDVIFSRWSELNRLNFQGFYTVLLERNEELISVATVRVYGKKVAEIPLVGTRLQYRRRGMCHILIEELEKNIEELEKVRRWRCADVVVTRIWVCGVEEGGVQSVVCSGTTVVPGLRGSNSLSLLLQIQEKGLCLDHLSLHFAAAIVNGGDDNDHHHHRKQGSNLGFVNGK

SEQ ID NO: 233056 - protein, 74 aa, Glycine max
  Coding DNA Sequence Number=SeqID_116278
  Subcellular localization annotation: CTP_CleavageSite=40; ConfidenceScore=5.20e-01
MGVTIPARFVFVDPVRVLNRSYHRFSFYLLFPFLQIPNSVSSTDSSSLRKRKRKPQEPPPLNERELIALQRHQF

SEQ ID NO: 233057 - protein, 349 aa, Glycine max
  Coding DNA Sequence Number=SeqID_116279
  Gene Ontology: Mol. function=hydrolase activity; Biological process =aromatic compound metabolic process
  Homolog annotation: Hit_ID=Q1SUN0; Match level="QueryCoverage=69%, HitCoverage=61%, E-value=1e-105, Identity=77%"; Hit description =Alpha/beta hydrolase
  Subcellular localization annotation: CTP_CleavageSite=22; ConfidenceScore=5.10e-01
MELSVPFRFRSRNLLSPSTHIPITYPSKHQPPFLTKFVNKPKISKLTVRAQRRAPIEGLSDELNAIARCNLDFAYTRRRVRAAFADMQQQLDHCLFKNAPAGIRTEEWYERNSRGLEIFCKSWMPKPGIPIKASVCFCHGYGDTCTFFFEGIARIIAASGYSVFAMDYPGFGLSEGLHGYIPKFDYLVDDVIEHYTKIKARPDLSGLPRFILGQSMGGAVSLKVHLREPNNWDGMILVAPMCKCLRQFFNIDEGLLNAIVNVSGKSVICLMLQLAVEHFRKLYKGMVSKIFCELEESLQMSIRIFFQIRMVKGTAICEKGIYSEKWCLGNTLGTVSWEGINLVRHYLIS

SEQ ID NO: 233058 - protein, 64 aa, Glycine max
  Coding DNA Sequence Number=SeqID_116280
MVIFSHGVAAKDKGEEEFPRICQRYLSIFPLDATRMEGVTRAHGKGICHKNILQEYSKNMPKAS

SEQ ID NO: 233059 - protein, 170 aa, Glycine max
  Coding DNA Sequence Number=SeqID_116281
MSVKEINAKSKDEYRWTKADQGTSPHAITQGLPLWKAWWATCRRDHQKQLGQNETPKPGGTTVMSGSAHCDTSIGTILMLISQGQKRHNNDMFFCKGSMEVVSTVESYELAVERTSDASTSLAMSSMWSIKDDCKRVKRCTISSSLSGWVLEFLDRVATTMSQRRERSSQ

SEQ ID NO: 233060 - protein, 209 aa, Glycine max
  Coding DNA Sequence Number=SeqID_116282
  Gene Ontology: Mol. function=RNA-directed DNA polymerase activity; Biological process=RNA-dependent DNA replication
MKLAHGSRHVELKGESDSGLTLLYFSQGLHFSIVVTNPYLRDLLHEFYFLFKEPTQLPPPRSTDHHFPLLPNSTLVNMRSYQYPYVQKLEIEVHVTKMFVTGWIQPTSSPFSSPKFLFKKKDCYWCMFIDYRALNALMEERCADSPPTFICGKRRKNRRKPIKTKILSSGVVFTFEKGINTSHVDKSGAFAPTYPPLKRKSDLRSSFLR

SEQ ID NO: 233061 - protein, 125 aa, Glycine max
  Coding DNA Sequence Number=SeqID_116283
  Homolog annotation: Hit_ID=Q10F72; Match level="QueryCoverage=39%, HitCoverage=22%, E-value=6e-18, Identity=79%"; Hit description =Expressed protein
MPPGLLGFKVVPDRGMETSPETYLIEETEYPLIIGSGNRASAGGAERLKGICRAPDRSDAETEGGCREGKGNRKWKRAFSGTQNVSSVQKDEAWRVNVRIQGCDLEHGYLCGTMEALNVPMADTP

SEQ ID NO: 233062 - protein, 262 aa, Glycine max
  Coding DNA Sequence Number=SeqID_116284
  Gene Ontology: Mol. function=DNA binding; Cellular component =chromatin; Biological process=DNA integration
  Homolog annotation: Hit_ID=Q1SRP4; Match level="QueryCoverage=97%, HitCoverage=64%, E-value=1e-36, Identity=35%"; Hit description =Integrase, catalytic region
  Subcellular localization annotation: CTP_CleavageSite=59; ConfidenceScore=5.70e-01
MSVDYSPQTSSQSNYTQHNGNSGQTFSDPHPSNVWTNNTYKSGNTSNQANPSASDMLTNAQPQSNSTNWIPDSEPFEGPEQIFIGNGQGLKIHYSGSSIFISPHNSSVSLSLNHLPHVPTITKNLISVSKFAKDNSVFFEFHANHCAVKSQVTNEVLLQGTVGPDGLYIFPNIQFHSSSAGVASYCLSSAVYSVNPATSKVNYPLDTCNKIDNSLVNPPCVAGKSRRLPSSPSNSVYSFPLELVYSDLWGPSHVPSTNGYLY

SEQ ID NO: 233063 - protein, 107 aa, Glycine max
  Coding DNA Sequence Number=SeqID_116285
MVTLHTPNSKGDASFANEKACLYLAPPSLTGHLSGVKPQPSASCKKTKDEHKAPLSYMAKFIPDRWFEGGDSLLGKRHVLAFCTIDSKFWFDCKILFIKPSSLCPNS

SEQ ID NO: 233064 - protein, 207 aa, Glycine max
  Coding DNA Sequence Number=SeqID_116286
  Homolog annotation: Hit_ID=Q6ZHC0; Match level="QueryCoverage=32%, HitCoverage=19%, E-value=7e-28, Identity=82%"; Hit description =Putative GAMM1 protein
  Pfam annotation: Domain name=UPF0160; Domain location=61-205; Score= -146.3; E_value=0.00019; Accession=PF03690.4; Description =Uncharacterised protein family (UPF0160)
  Subcellular localization annotation: CTP_CleavageSite=59; ConfidenceScore=5.00e-01
MAEWHRGFLDKRHQIAVALRGMSTSATKAPAPHTSTPRTRRTDDGCGGNGYSLRRQRVYGSLENVDKADAYQVAGVLVLEDLDAVLDVGGVYDPARDRYDHHQKGFEEVFGHGFSTKLSSAGLVYKHFGKEIIAKELKVDEEHRDVHYIYLAVYKSFMECRSVRAIKKSKSMDVTNGIGANLSPNTLWFEDELGKNWWACNTAIESH

SEQ ID NO: 233065 - protein, 173 aa, Glycine max
  Coding DNA Sequence Number=SeqID_116287
  Gene Ontology: Mol. function=nucleic acid binding; Cellular component= chromatin; Biological process=DNA integration
MPEAQPISSPMASSCKLTKAGSDLFTDPTLYSYSRALCDADWASDVDDRRSTSGVAIYLGLNLISRWSCKQQVVARSSREAEYRSLAVTAAELSWIQTLLNELQVPFSTPIVFCDNQSAVALAHDPVLHMIVHHVPALDQWANALTKPLSPSRFTFLRAKLNVLETPLKSHPP

SEQ ID NO: 233066 - protein, 97 aa, Glycine max
  Coding DNA Sequence Number=SeqID_116288
  Gene Ontology: Mol. function=nickel ion binding; Cellular component =cytosol; Biological process=protein complex assembly
  Homolog annotation: Hit_ID=Q9FHY6; Match level="QueryCoverage=64%, HitCoverage=18%, E-value=2e-23, Identity=76%"; Hit description=GAMM1 protein-like
  Pfam annotation: Domain name=UPF0160; Domain location=1-96; Score= -147.6; E_value=0.00022; Accession=PF03690.4; Description =Uncharacterised protein family (UPF0160)
MPIPLPAASHSTPFYNNFLDRLSDERSKQWRVQAVAVSPDSFQSRKALPSQWQGLRDEELSKESGIPGCVFVHMSGFIGGNKNFDGALAMAKAALTM

SEQ ID NO: 233067 - protein, 109 aa, Glycine max
  Coding DNA Sequence Number=SeqID_116289
  Subcellular localization annotation: CTP_CleavageSite=51; ConfidenceScore=5.19e-01
MDIVKENIQLKSTLVSGLELPHCSAIISASSSSHHNHRNMPVRVLENTAAPSSQVSGANSGRSSCQSCSLLGVGQQPVPVSDDGDLYGYLRRHSLGQCGSARIECQRKQ

SEQ ID NO: 233068 - protein, 498 aa, Glycine max
  Coding DNA Sequence Number=SeqID_116290
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=90%, HitCoverage=65%, E-value=1e-165, Identity=63%"; Hit description =Lectin-like receptor kinase 7;3
  Pfam annotation: Domain name=Lectin_legB; Domain location=55-297; Score=360.0; E_value=3.7e-105; Accession=PF00139.10; Description =Legume lectin domain
  Pfam annotation: Domain name=Pkinase; Domain location=379-498; Score=- 88.5; E_value=0.0027; Accession=PF00069.15; Description=Protein kinase domain
  Pfam annotation: Domain name=Pkinase_Tyr; Domain location=379-498; Score=-100.5; E_value=2.6e-06; Accession=PF07714.7; Description =Protein tyrosine kinase
  Pfam module annotation: Pfam domain module=Lectin_legB::Pkinase::Pkina se_Tyr; Domain location=55-297::379-498::379-498
MAINILNPQKAQASPSNLSIFEVLDFPHLLMATNLNMLLKFLSLLVFLLIPVSSQQNQLFYAGFKGLKSNNMTLDGVAEIEPNGVLKLTNDSSKVMGHAFYPTPFRFKNSSGGGNKAFSFSSSFALAIVPEFPKLGGHGLAFAIAPTKELKAHPSQYLGLLDSTGIGNFSNHLFAVEFDTAKDFEFGDIDDNHVGIDINSLSSIASASAGYYSGDEDSTKQNVTLQSGVPILAWVDYDAAQSVVHVTISASSTKPKRPLLSYHVDLSPIFEDLMYVGFSASTGMLASSHYILGWSFKINGPALPLDLSSLPQLPGPKKKHTSLIIGVSASVVFLVLCAVLLGIYMYRRYKNADVIEAWELEIGPHRYSYQELKKATKGFKDKGLLGQGGFGSVYKGTLPNSNTQVAVKRISHDSNQGLREFVSEIASIGRLRHRNLVQLLGWCRRRGDLLLVYDFMENGSLDKYLFDEPEIVLSWEQRFKVIKDVASALLYLHEGYEQ

SEQ ID NO: 233069 - protein, 129 aa, Glycine max
  Coding DNA Sequence Number=SeqID_116291
VGDDIKVFPTCVDEILLKTWAVRFKFRSQLRQSSVLDVSEELHHIQSLIATLGLKEQSNKGKGIAVEPESSPPIFVPTPPLPQSSDYDPGNSTCLTPTKRISCQQSSSDFDSDEHAQYQLSTNKHIKAE

SEQ ID NO: 233070 - protein, 79 aa, Glycine max
  Coding DNA Sequence Number=SeqID_116292
  Homolog annotation: Hit_ID=Q8LFV2; Match level="QueryCoverage=46%, HitCoverage=10%, E-value=4e-11, Identity=83%"; Hit description=Acid phosphatase type 5
MVDSVLGNHDYMGDAEAQLSPVLREIDSRWLCSRSFIVDSGDALSTLTLKELKQLENRLERGITRIRSKKVRCKCCNNV

SEQ ID NO: 233071 - protein, 166 aa, Glycine max
  Coding DNA Sequence Number=SeqID_116293
  Pfam annotation: Domain name=zf-CCHC; Domain location=47-64; Score =12.5; E_value=0.0086; Accession=PF00098.13; Description=Zinc knuckle
MLDNFAKVWEPKTTTIQEMMKKGKFQHSSRHKDSIFKKKNQEENNEIICFECRKPGLMKAKCPQQKKRRYSRGKKKKSLMITWDDLDSEKSDSLDDEQANICLMIDTNDELPFSRSIQFQPVASHADVVREKRGTKTILANGQLRDLIIFLMGKSQLKGRTSFSFR

SEQ ID NO: 233072 - protein, 345 aa, Glycine max
  Coding DNA Sequence Number=SeqID_116294
  Gene Ontology: Mol. function=protein serine/threonine kinase activity; Cellular component=ubiquitin ligase complex; Biological process=protein amino acid phosphorylation
  Homolog annotation: Hit_ID=Q9FKG6; Match level="QueryCoverage=78%, HitCoverage=30%, E-value=2e-36, Identity=34%"; Hit description =Receptor kinase-like protein
MGIGGAEGKEIDKILEADTNNMSQHSSSSVVALAIKGDKKSKYVVQCALNKFVPEGMIIFKLIHVHAGIKGVPTPLGNVIPLSQVRNDVATAFKKEVEWQTNQMLLPFKIMCEQRKVHVDVVVIESDDVATAVAEEVAKGAITKLVVGASSHGLFKSKQKGMSTKISVCTPRFCTIYAISKGKLSIRPSDMPIGGSIIDDASESETSLSTSSSSNYNSTSQTESASVSSYAGLQSSSLTTQRFQALSSINSALLSTNPSFPDTNHSRGQSLDLGTENTATSSARNSDIDHALSRVSSCKSFISDTESWMYDQNSSKEVQLETTLPSPNRQVMEPSWKKKSYTLVI

SEQ ID NO: 233073 - protein, 69 aa, Glycine max
  Coding DNA Sequence Number=SeqID_116295
  Gene Ontology: Cellular component=endoplasmic reticulum
  Homolog annotation: Hit_ID=Q8VZU9; Match level="QueryCoverage=90%, HitCoverage=34%, E-value=3e-15, Identity=47%"; Hit description =Derlin-1
MGISLVFMIVYVWSREFPNARINIYGVVSLKGHLYYFLTVLHPLAGGKFKFKTPLWVYPFLPRSYGHYD

SEQ ID NO: 233074 - protein, 95 aa, Glycine max
  Coding DNA Sequence Number=SeqID_116296
MRLNAEIQLEESRVGASCWNLLELVRQNSIGCFHTTKTPLLIEKEFSKNGGSLRRQSSKLLDDHDWYLGNDRRNELSLGVKFRLVNDITEPTWKL

SEQ ID NO: 233075 - protein, 86 aa, Glycine max
  Coding DNA Sequence Number=SeqID_116297
MKDNGGLRSTYLKLLNIPRICQRHLNIFQEYAKGILAYCKNMPKASWHISFRCYKNGRCYSNTWERNMPQEYSKGIFQEYAKGILA

SEQ ID NO: 233076 - protein, 105 aa, Glycine max
  Coding DNA Sequence Number=SeqID_116298
  Subcellular localization annotation: CTP_CleavageSite=47; ConfidenceScore=5.07e-01
EALFTLKKRNQKKLLAYKGVGMSPPPLGISQSLKNSLISLKDENLAPCSTLRSLKFTLFRPLSRLPDLDVALSANLALSATRACIADVFPDSPLLAKHAGVGLSR

SEQ ID NO: 233077 - protein, 254 aa, Glycine max
  Coding DNA Sequence Number=SeqID_116299
  Gene Ontology: Mol. function=protein binding; Cellular component =membrane fraction
  Homolog annotation: Hit_ID=Q9FF60; Match level="QueryCoverage=49%, HitCoverage=63%, E-value=3e-40, Identity=61%"; Hit description =Arabidopsis thaliana genomic DNA, chromosome 5, P1 clone:MUP24
  Pfam annotation: Domain name=Sua5_yciO_yrdC; Domain location=72-214; Score=9.7; E_value=1.3e-07; Accession=PF01300.8; Description=yrdC domain
MEQSIGERRLAYDECFYARTAYPQRSLLFQFLLPRLSVFPPSQQCEGPRRGFSKNMSCSVSVDNSDMVHPATDAYAGEAVEALKAGSLEAVNRIYEIKGRRHTSPLAICVGDVSDIARFAVTDHLPHGLLDCLLPGPESSILERSLNPGFDSIGVRVPDCNFIRIIACGSGTALALTSANLSGQSSNPSGVYPDLSSFTGSGVYPDLSSFTGSGVYPNLSSFTGSGVYPDLSSFTGSGVIQTFVACIKRSAPTQ

SEQ ID NO: 233078 - protein, 64 aa, Glycine max
  Coding DNA Sequence Number=SeqID_116300
  Homolog annotation: Hit_ID=Q1SCK8; Match level="QueryCoverage=78%, HitCoverage=9%, E-value=5e-18, Identity=82%"; Hit description =Protease-associated PA; Peptidase A22B, minor histocompatibility antigen H13
MGHVGTILLNCAFLYDIFCAFVSKRWFHESVMIVIARGDKSGKDGIPMLLKIPRSVLLEIGGAT

SEQ ID NO: 233079 - protein, 164 aa, Glycine max
  Coding DNA Sequence Number=SeqID_116301
  Gene Ontology: Mol. function=transferase activity; Cellular component= oxygen evolving complex; Biological process=DNA integration
  Homolog annotation: Hit_ID=Q1SXA8; Match level="QueryCoverage=94%, HitCoverage=12%, E-value=2e-28, Identity=39%"; Hit description=Zinc finger, CCHC-type; Polynucleotidyl transferase, Ribonuclease H fold
MKDGNWVKVMQEEPDQFQKNDVWKLVELPKGKKVVRAKWVFCNKLDKGGKVMKQGKVICQRLLTIGSNMKVYQMDVKSASLNGLIQEEFYVEQPPGFESETLPKHVFKINKDLYELQQPPKAWHWVLGKKFRISDHVGTGVEYITEFGMSNREEWRIVKLQWIK

SEQ ID NO: 233080 - protein, 514 aa, Glycine max
  Coding DNA Sequence Number=SeqID_116302
  Gene Ontology: Mol. function=nucleoside-triphosphatase activity; Cellular component=integral to membrane; Biological process=transport
  Homolog annotation: Hit_ID=Q9FF46; Match level="QueryCoverage=98%, HitCoverage=45%, E-value=0.0, Identity=65%"; Hit description =Putative white-brown complex homolog protein 29
  Pfam annotation: Domain name=ABC2_membrane; Domain location=264-461; Score=-16.1; E_value=0.01; Accession=PF01061.14; Description=ABC-2 type transporter
  Pfam annotation: Domain name=ABC_tran; Domain location=1-123; Score= -5.8; E_value=5.6e-07; Accession=PF00005.17; Description=ABC transporter
  Pfam module annotation: Pfam domain module=ABC2_membrane::ABC_tran; Domain location=264-461::1-123
MVVSYYRRLSADMPKPDKVLIVERVIESLGLQAVRDSLVGTVEKRGISGGQRKRVNVGMEMVMEPSLLILDEPTTGLDSASSTLLLKALRREALEGVNICMVLHQPSYTLFRMFDDIIFLAKGGLTAYHGPVKKVEEYFASIGITVPDRVNPPDHFIDILEGLVKPNGNVTHQQLPVRWMLHNSYPVPPDMLHFADQIAASSSSSSTSNVNDAIKGADEAVDQSFANEFWEDMKSNVQMQRDHIEATFLKTKDLSNRRAPGVSRQYRYYLGRICKQTLREGKSQAVDYLLLLVAGAILGTLTKVNDETFGSLGYTYTVIAVSLLCKIAALRAFSLDKLQYWRESASGISSLAHFLAKDTIELFNIIIKPVVYLSMFYFFSNPRSSFGSNYAVLVCLVYCVSGMAYAIAIYFEPAPAQLWSVLLPVVMTLIANQTRDTVFMKILVKLCYPNWALEAFIIANAERFTGVWLITRCSSLMNSGYNVSDWPLCLVALIFYGIIARVVAFFCLVITQKK

SEQ ID NO: 233081 - protein, 157 aa, Glycine max
  Coding DNA Sequence Number=SeqID_116303
  Gene Ontology: Mol. function=protein kinase activity; Biological process=protein amino acid phosphorylation
  Homolog annotation: Hit_ID=Q9LZF8; Match level="QueryCoverage=80%, HitCoverage=29%, E-value=2e-27, Identity=51%"; Hit description =Protein kinase-like
  Subcellular localization annotation: CTP_CleavageSite=41; ConfidenceScore=5.13e-01
MQSSSSQVAMKCFSFYFGEKKDGHKSLQSILSRFNSSTYVEAEMRRSGSELNSMDASDNSTDSLRRSSFPSLSQRPSNLRVFTVSELKTATKSFSRSVMLGEGGFGCVYKGLIKSVDDPSTKIEVAVKQLGRRGIQARFCFAFYVVLLKYFELLIHW

SEQ ID NO: 233082 - protein, 369 aa, Glycine max
  Coding DNA Sequence Number=SeqID_116304
  Gene Ontology: Mol. function=nucleoside-triphosphatase activity; Cellular component=integral to membrane; Biological process=transport
  Homolog annotation: Hit_ID=Q9FF46; Match level="QueryCoverage=71%, HitCoverage=23%, E-value=7e-96, Identity=68%"; Hit description =Putative white-brown complex homolog protein 29
MRNCASWLPLLFTLIPLLASRIRCADNNFAPSFYSEEIYKELQNLASLLNKDIKAVSDHASNEIASCGTSFPQRAEPNVGIATRRRRKAKSRESAARQVRETVQARERWKIAKDVAKKGRGGLQEQLSRTFSRKKSLKQPDHSSQAKRGTGDTFLPPMPPNSSGMYEQPSAGSKAQNKEPTNLTKMLNSFEDDPHSNEGFNLQIGDKNIKKQMPKGKNLHTQSQILRYAYGQIEKEKAQQEKNKDLTFSGVISMATEGDVRTRPVIEVAFKDLTLTLKGKRKHIMRCVSGKLMPGRVSAVMGPSGAGKTTFLSALAGKTRGCTMTGSILINGKPESIHCYQKIIGYVPQDDIVHGNLTVEENLRFSARC

SEQ ID NO: 233083 - protein, 73 aa, Glycine max
  Coding DNA Sequence Number=SeqID_116305
MHTSGAEAVSDEGEGTKEGLGEDMGGGELVAGLVGVLDGEDLGGGGDRGKWKRVAEIDDNGRVIDGMMLLRLL

SEQ ID NO: 233084 - protein, 205 aa, Glycine max
  Coding DNA Sequence Number=SeqID_116306
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=88%, HitCoverage=32%, E-value=6e-96, Identity=96%"; Hit description =Probable 2-isopropylmalate synthase
  Pfam annotation: Domain name=HMGL-like; Domain location=41-205; Score= -6.4; E_value=3.4e-07; Accession=PF00682.9; Description=HMGL-like
MATKTSIPSSQSPKLSRLRPQYIPNHIPDSSYVRILDTTLRDGEQSPGATMTAKEKLDIARQLVKLGVDIIQPGFPSASNSDFMAVKMIAQEVGNAVGDDGYVPVIASFCRCVEKDIATAWEAVKYAKRPRLCTSIATSPIHMEHKLRKSKDQVIQIARDMVKFARSLGCNDIQFGAEDATRLRENEQNRKSCKKNREVNISILK

SEQ ID NO: 233085 - protein, 243 aa, Glycine max
  Coding DNA Sequence Number=SeqID_116307
  Gene Ontology: Mol. function=protein kinase activity; Cellular component=chloroplast; Biological process=protein amino acid phosphorylation
  Homolog annotation: Hit_ID=Q9LZF8; Match level="QueryCoverage=96%, HitCoverage=63%, E-value=1e-98, Identity=69%"; Hit description =Protein kinase-like
  Pfam annotation: Domain name=Pkinase; Domain location=1-213; Score =62.9; E_value=1e-15; Accession=PF00069.15; Description=Protein kinase domain
  Pfam annotation: Domain name=Pkinase_Tyr; Domain location=2-213; Score=19.1; E_value=1.2e-13; Accession=PF07714.7; Description =Protein tyrosine kinase
  Pfam module annotation: Pfam domain module=Pkinase::Pkinase_Tyr; Domain location=1-213::2-213
GHKEWVTEVNVLGIVEHPNLVKLVGYCADDDERGIQRLLIYEYMPNRSVEHHLSPRSENPLPWNRRLKTAQDAARGLAYLHEEMDFQIIFRDFKSSNILLDEQWNAKLSDFGLARLGPSDGLTHVSTAVVGTMGYAAPEYVQTGRLTSKIDVWSYGVFLYELITGRHPIDRNRPKGEQKLLEWSAQKLAIIANRCLVKNPKNRPKMSEVLEMVTQVVESTVSTNQQPPLKSVAASAEASQGTK

SEQ ID NO: 233086 - protein, 270 aa, Glycine max
  Coding DNA Sequence Number=SeqID_116308
MEGSRTVTTEQTPYHGGWARKITKVYIAGRKDKKRARFEFTRFKDVKDAQRLWLSDWTKYLLKVESLWLICPNSLEGGRNSKRWPEVKRSGKPLSLQDAFDSNIVTCNKRNKAMLEGEVALSVWSIAKEMGVRGEQTISSKTFGKNGIWGTMRDLSLNVHGMKVWAKCRRIRSLVLESKKLRVLKNSLKEWSKLMLARMDHKIDDKVSEMEVIGCQFLDDIVAQAEKQRVLAMAQEFWSIIRIKESSILKNPGPNGLSLGIQIVDFLTHT

SEQ ID NO: 233087 - protein, 121 aa, Glycine max
  Coding DNA Sequence Number=SeqID_116309
MVHSGGAHNPNSPQAFILFPVTPLILIEPNQDILNPQSFLSLNPLTPSSTHIQNTSAKPINPSTQIQKWWTIVVGCVEDIVVEGDGMHRGGRGQGSAREGVVTRFGSGMGEGGDTCVLYLG

SEQ ID NO: 233088 - protein, 245 aa, Glycine max
  Coding DNA Sequence Number=SeqID_116310
  Homolog annotation: Hit_ID=Q9FNJ1; Match level="QueryCoverage=88%, HitCoverage=46%, E-value=2e-13, Identity=29%"; Hit description =Arabidopsis thaliana genomic DNA, chromosome 5, P1 clone:MDJ22
  Pfam annotation: Domain name=F-box; Domain location=25-72; Score =29.3; E_value=1.3e-05; Accession=PF00646.23; Description=F-box domain
  Pfam annotation: Domain name=LRR_2; Domain location=179-203; Score =17.5; E_value=0.049; Accession=PF07723.3; Description=Leucine Rich Repeat
  Pfam module annotation: Pfam domain module=F-box::LRR_2; Domain location=25-72::179-203
MTQGMIIAIQGSRNMARNRFENNRDIISTMPDDILGDILSRLTLKEAARTSVLATKWRYHWTFFSGLLDFDHSLRNFHLRREHVGILTKCNVFVYEWERFMTRMANVMKSLKSSSLQGLRICMDLGDPWRVAEWVKYAAEKHVQTLDLDFSYHFSVPFYEISLTIVHNVFPSRGYEMKSLCNLRLSSVDVSGEVIEGLLASCPLLESICVIESKRLVRLKVRGEALRLKHLELVECRIMDLDIYA

SEQ ID NO: 233089 - protein, 87 aa, Glycine max
  Coding DNA Sequence Number=SeqID_116311
MVLSLLVLTMCNVVDVIEVSPFEGTKAIGSYLHILTEDDLPHAHKINNVVLDVNDGGVKDREPEVEELRHHANDLQCQITDILFGLE

SEQ ID NO: 233090 - protein, 123 aa, Glycine max
  Coding DNA Sequence Number=SeqID_116312
  Subcellular localization annotation: CTP_CleavageSite=56; ConfidenceScore=5.15e-01
MRATSVAENPFLITMIAQALVSSSGQLFHRKAFNRGFQVWREGSGRDKRRRVGPIMVATVVEFLLVQLWVETPALRGGVQGRSKMKQLSKEGGARLTMRFARCLNSVRYSFTESCCWSLNKAH

SEQ ID NO: 233091 - protein, 39 aa, Glycine max
  Coding DNA Sequence Number=SeqID_116313
MIRERLAGRLCSRDKSRGTIFNTFSVQDLERWGHFEAHL

SEQ ID NO: 233092 - protein, 163 aa, Glycine max
  Coding DNA Sequence Number=SeqID_116314
  Gene Ontology: Mol. function=transferase activity, transferring acyl groups, acyl groups converted into alkyl on transfer; Biological process=branched chain family amino acid biosynthetic process
  Homolog annotation: Hit_ID=Q39891; Match level="QueryCoverage=41%, HitCoverage=12%, E-value=2e-31, Identity=100%"; Hit description =Probable 2-isopropylmalate synthase
MPLELGKLIVDIKDNTPGIANVIISTHCHNDLGLATANTIEGARTGARQLEVTINGIGERAGNASLEEDSGEVNGSIDANTLDIFSGLEETGDRLTENWRPALLLLEIAFLQRWTLGFCHNQPLMNFNLVVGKRGFKMCEVKARAEVEPNLKKKAREVMAWEP

SEQ ID NO: 233093 - protein, 141 aa, Glycine max
  Coding DNA Sequence Number=SeqID_116315
  Gene Ontology: Mol. function=RNA-directed DNA polymerase activity; Cellular component=chromatin; Biological process=chromatin assembly or disassembly
MPLPETFCIYDTIAHHRVVILVDSESIHNFLQPRLANFLHLPSNPTSTMRVMISDCTMLDCTSMCLNIPITIQRHTFPVDLYPLPIGGTNIVLGVQWLKLLGPVTIDHSALTMSFTYLVHNITLQADVPFTQAQPQPNNSN

SEQ ID NO: 233094 - protein, 366 aa, Glycine max
  Coding DNA Sequence Number=SeqID_116316
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=45%, HitCoverage=42%, E-value=4e-45, Identity=49%"; Hit description =Integrase, catalytic region
  Pfam annotation: Domain name=rve; Domain location=144-273; Score =11.9; E_value=0.0006; Accession=PF00665.16; Description=Integrase core domain
MAPETLRMMGSMSDQKVLILVDGGSTHNFIEERLVTMLGLHAQSTPLLRVMIGNGIEIEYHLQHLDCAFWILQDGQFFLKLSKCCVVQQQIEYLGHVVSATGFYRCFIKGYATIAALLIHPLTKEHLVWSPEALLAFHALQEAVSSAPGIVLTLLMPYFIFMDELKGELAGNPKFNALRQDLQENPTNRPTLTYTDGLQELFKLSGTKLHLSSTYHPQSDGQTKVMNRIIEQFMHAFVHHHPLPWGKFLPWVEWSYNTSRNTSTGTSPFEVTYGNKPSTILQYITSSSSVEAVDTLLTTWEAVFDSLRHKLLKVKAQMKHFANNKHPEVHYAKGDWAMVKLHPLRQSSLTGPNKTKLAKRFYGPFK

SEQ ID NO: 233095 - protein, 183 aa, Glycine max
  Coding DNA Sequence Number=SeqID_116317
MDRVDFYGVLLQINVLKLELSKPYPGFLEGLPVFDNVGQLEIRIPHRSGAALDHHVSLLSSFPSVRVLKIKSYGDPDADHFQRNDLSVVEENWKANLEHEYPNLRELEVSGFRRDPSQMELLISIFEKAPNLNSVVVDPLSSIHVDRSPDVKARYREMRRETTKWLADALKPHLPPLTQLIVL

SEQ ID NO: 233096 - protein, 85 aa, Glycine max
  Coding DNA Sequence Number=SeqID_116318
MAIYAFRMIQAEAGGHVTPRLNHTRMGRIQHCADYTIKNELNELIGDTYTNKIHLLFDSPSLKNSILKSAWLGPIMGWVAFWKAS

SEQ ID NO: 233097 - protein, 183 aa, Glycine max
  Coding DNA Sequence Number=SeqID_116319
MEKSKGKVEEEKCECKVYVEVFLEKKSVYKWSKATQILLCVCYIPKQCYTASLNNAKLESYKLKPCKLQAPATEKAEAPASPEASREAWPVSPALWASPTWPYLAITVGESHVAWVSPFALATLSSLPPTWLISLLLLAALSSFHLCRQWVWRVQPCRQWQWRLQPNNRPPPSFLLKQTPIRK

SEQ ID NO: 233098 - protein, 146 aa, Glycine max
  Coding DNA Sequence Number=SeqID_116320
MNDKQNVKENGYRMQYRTLKNDGCEREKHLKAIAYPTTLHLKKSIEFKFYPNRICQRFPIINFHKRKGVEPEEVDMATKAKVEFQQYFELFKEEEEKEIETTFNNAWSLHLVRTYHFTNTMIIDEEDITYLKNSYTYWILVHCLIG

SEQ ID NO: 233099 - protein, 86 aa, Glycine max
  Coding DNA Sequence Number=SeqID_116321
MANKLQLIFRLTDPNMASYLVLIGPKQCQIPRASSKWQSDDMVVLPAAAIVKLHLHHNALTQSHVASTSPCLRYGKLLLCETSKKN

SEQ ID NO: 233100 - protein, 97 aa, Glycine max
  Coding DNA Sequence Number=SeqID_116322
  Homolog annotation: Hit_ID=Q1T2D5; Match level="QueryCoverage=49%, HitCoverage=3%, E-value=3e-07, Identity=72%"; Hit description=Chromo
MVKGMVKSDVANTKACVIISFNWSNAANPAWPGFCWGLGPLHETTPHGQGLVLRTKKHDPVHPVAHHSSDGKMVLNGDSIECPIVNTTALAAIIFLN

SEQ ID NO: 233101 - protein, 190 aa, Glycine max
  Coding DNA Sequence Number=SeqID_116323
  Gene Ontology: Biological process=regulation of transcription
  Homolog annotation: Hit_ID=Q70I19; Match level="QueryCoverage=49%, HitCoverage=22%, E-value=1e-28, Identity=68%"; Hit description=TCP -domain protein
  Pfam annotation: Domain name=TCP; Domain location=27-190; Score =143.0; E_value=8.2e-40; Accession=PF03634.4; Description=TCP family transcription factor
  Subcellular localization annotation: CTP_CleavageSite=34; ConfidenceScore=5.53e-01
MTSQVVLHNNFETQPSVTVTTATNTESPPTAPPSLAVVKRPSTKDRHTKVNGRGRRIRMPPLCAARIFQLTRELGHRSDGETIEWLLRHAEPSIIAATGSGTVPAAPVSSVAPSAPSSEPMVACPVTAVGAQGMFAMAPPQPQPNCRLDLSPPAGLEFAVNGYRHMPFTALLLQPATAEDNQNDESLGEQ

SEQ ID NO: 233102 - protein, 426 aa, Glycine max
  Coding DNA Sequence Number=SeqID_116324
  Gene Ontology: Mol. function=protein serine/threonine kinase activity; Cellular component=nucleus; Biological process=protein amino acid phosphorylation
  Homolog annotation: Hit_ID=Q1SJP6; Match level="QueryCoverage=96%, HitCoverage=96%, E-value=1e-154, Identity=66%"; Hit description =Protein kinase
  Pfam annotation: Domain name=Pkinase; Domain location=117-396; Score =167.2; E_value=4.1e-47; Accession=PF00069.15; Description=Protein kinase domain
  Pfam annotation: Domain name=Pkinase_Tyr; Domain location=117-397; Score=5.2; E_value=8.6e-13; Accession=PF07714.7; Description=Protein tyrosine kinase
  Pfam module annotation: Pfam domain module=Pkinase::Pkinase_Tyr; Domain location=117-396::117-397
MLNKTLSFAMGCCSCFGFIRTPNRQSQRSKPTTNNNLCQEPLLDDDIEDEEGEPLYNDEVTNNSGDEGAEETRPKRSEEILNFRVENGMICRQFPVKETRKLVRSEDENGNKMINEYIREYKIGSGSYGKVALYRSSVDDKHYAIKVRKLFGGQTDYCRKHGHMGMAFHKSYLLKLRVAPSETAMMDVLREVLIMKMLEHPNIVNLIEVIDDPETDNFYMVLEYVEGKWICEGSGPTCGLGEETARRYLRDIVSGLTYLHAHQNIVHLDIKPDNLLITCHGTVKIGDFSVSQAFEDDKDELRRSPGTPVFTAPECVKYGGKAADTWAVGVTLYCMILGEYPFLGDTLQDTYDKIVNNPLVLPNDMNPPLKNLIEGLLSKDPSLRMTLGAVAEDSWVIGDDGPIPDYLCWCKRKSLGIEDNDESNTD

SEQ ID NO: 233103 - protein, 77 aa, Glycine max
  Coding DNA Sequence Number=SeqID_116325
MAPKKLLSKRAMKDAVGEGSSAAPQTDMEFDEHWFRTEENQRHFEVIKGWSFLKERLVQLREIILLVLHCKLILSYP

SEQ ID NO: 233104 - protein, 68 aa, Glycine max
  Coding DNA Sequence Number=SeqID_116326
  Homolog annotation: Hit_ID=Q7XXN8; Match level="QueryCoverage=53%, HitCoverage=69%, E-value=1e-14, Identity=83%"; Hit description =Hypothetical protein ROT4
MVLVPRPWLSAHANTEAWLRNGEECRILLAASSQDGCTSGQKTCRDHKLDAVAAADDCFGLCCFPALP

SEQ ID NO: 233105 - protein, 386 aa, Glycine max
  Coding DNA Sequence Number=SeqID_116327
  Gene Ontology: Mol. function=sugar binding
  Homolog annotation: Hit_ID=Q1SN84; Match level="QueryCoverage=99%, HitCoverage=100%, E-value=1e-152, Identity=68%"; Hit description =Root cap
  Pfam annotation: Domain name=Root_cap; Domain location=314-370; Score= 117.5; E_value=3.7e-32; Accession=PF06830.2; Description=Root cap
MGGRKWSILVAIFILLLAMEAVIAQGQGNGNGNGNGNGKDKDKEEKEREKREKKEKKEKEKEKKEKEKKDKKQRDEATNYDKLSSLPTGQERGFCRTNTTCEFKTIVCPSECASRKPKKNKKQKACFIDCSSSTCEATCKVRKANCDGYGALCYDPRFVGGDGVMFYFHGAKGGNFAIVSDDEFQINAHFIGTRPQGRTRDYTWVQALAVMFDTHTLVIAANRVSHWDDKVDSLIVKWDDELVNIPTDGEAEWRINGDEREVVVERTDGTNSVRVTVSGLVEMDISVKPIGEQENKVHNYQLPSDDAFAHLETQFKFKKSTDNFEGVLGQTYRPGYVSPVKRGVPMPMMGGEDKYQTLSLFSTSCNLCKFHRPSEIASIEGLVAQY

SEQ ID NO: 233106 - protein, 309 aa, Glycine max
  Coding DNA Sequence Number=SeqID_116328
  Gene Ontology: Mol. function=sugar binding
  Homolog annotation: Hit_ID=Q1SN84; Match level="QueryCoverage=79%, HitCoverage=79%, E-value=6e-76, Identity=58%"; Hit description=Root cap
  Pfam annotation: Domain name=Root_cap; Domain location=237-293; Score= 103.6; E_value=5.9e-28; Accession=PF06830.2; Description=Root cap
MGGRKWSILVAIFILLLAMEAVIAQGQGNGNGNGKGKDKEEKEREKREKREKEKKEKKQRDGTNYDKLSPLPTGQERGAHTEIPRRTRSRRLVSLTAAAAHVKPLARLVCLTVRKANSDGYGSLCYDPRFVGGDGVMFYFHGAKGGNFAIVSDDDFQINAHFIGTRPQGGTRDYTHGANGDEREVVVERTDETNSVRVTVSGLVELDIGVKPIGEQENKVHNYQLPSDDAFAHLETQFRFKKSTDNFEGVLGQTYRPGYVSPVKRGVPMPMMGRENQYQTFSLFSTSCNLCRFQRPSGIASTEGLVAQY

SEQ ID NO: 233107 - protein, 405 aa, Glycine max
  Coding DNA Sequence Number=SeqID_116329
  Gene Ontology: Mol. function=beta-galactosidase activity; Cellular component=beta-galactosidase complex; Biological process =carbohydrate metabolic process
  Homolog annotation: Hit_ID=Q1SN78; Match level="QueryCoverage=99%, HitCoverage=74%, E-value=1e-102, Identity=65%"; Hit description =Rhodopsin-like GPCR superfamily; D-galactoside/L-rhamnose binding SUEL lectin; Galactose-binding like
  Pfam annotation: Domain name=Glyco_hydro_35; Domain location=34-281; Score=-43.2; E_value=1.7e-12; Accession=PF01301.10; Description =Glycosyl hydrolases family 35
MRVTQILFVLLWFFCVYAPLRFVQMSRMTTEHGSLMASAESWSLMWSDLIQKSKDGGLDVIETYVFWNLYEPVQGQAVAAAGLYVHLRIGPYACAEWNYGGFPLWLHFIPGIQFRTDNKPFEAAVYKTGSVCAAFLANIATSDATVTFNGNSYHLPAWSVSILPDCKNVVLNTAKINSAPMISSFTTESLKEEVGSLEGSDSGWSWISEPIGISKADSFPKFGLLEQINATADKSDYLWYWLRYIVYLQGLESFLLTSNSLPHDDAGSQTVLHIESLGHALHAFINGKLVGSGTGNSGKAKVNVDIPVPLVAEKNAIDLLSLTVELQNYGAFFDTWGAGITGLVISKGLKNGSTVDLSSQQWTYLVGLKYEDLGPSSGSSGQWNSQSTLPTNQSLTWYKVIFIRM

SEQ ID NO: 233108 - protein, 107 aa, Glycine max
  Coding DNA Sequence Number=SeqID_116330
QNESGGTSDNDGSDGHDNNDDVCEVIMVAMTQMMGEIVTIMMMVWSGQVAYQIDYTSNPMQSGRVMLKGGNTLGHVGQLSENNDNNNDGGEMVAMVVATMLVVIVVE

SEQ ID NO: 233109 - protein, 194 aa, Glycine max
  Coding DNA Sequence Number=SeqID_116331
  Gene Ontology: Mol. function=sequence-specific DNA binding; Cellular component=intracellular; Biological process=regulation of transcription
  Homolog annotation: Hit_ID=Q1SN76; Match level="QueryCoverage=68%, HitCoverage=71%, E-value=6e-30, Identity=55%"; Hit description =Transcription factor CBF/NF-Y/archaeal histone
  Pfam annotation: Domain name=CBFD_NFYB_HMF; Domain location=88-149; Score=42.5; E_value=1.5e-09; Accession=PF00808.13; Description =Histone-like transcription factor (CBFNF-Y) and archaeal histone
MASSNTPKPENKKSTKKSEISKAEKKKTKNAEIPKTDGKTKKNKEISQEENKKKIKKAKLSNGTSKQRDEGSKKGVAAEGNGEEAKMNVFPMNRIRTMIKGEDPEMRVSQEALFAINNTVEKFLEQFTQDAYAFCAQDRKKCLSYDHLVYFSLHSPYPTYKVFYIALARSDFVPERVKAEDALRERSAAGKGGS

SEQ ID NO: 233110 - protein, 42 aa, Glycine max
  Coding DNA Sequence Number=SeqID_116332
MARMKVKAGPRLAIDEASVGELKLLAIKMQNKKHSFRSATEY

SEQ ID NO: 233111 - protein, 635 aa, Glycine max
  Coding DNA Sequence Number=SeqID_116333
  Gene Ontology: Mol. function=diacylglycerol kinase activity; Cellular component=integral to membrane of membrane fraction; Biological process=protein kinase C activation
  Homolog annotation: Hit_ID=Q6USK2; Match level="QueryCoverage=95%, HitCoverage=96%, E-value=0.0, Identity=54%"; Hit description =Ceramide kinase
  Pfam annotation: Domain name=DAGK_cat; Domain location=165-389; Score= 35.2; E_value=2.3e-07; Accession=PF00781.14; Description =Diacylglycerol kinase catalytic domain
MEREGNDCVVGDTSLTASPFDGEASILRSTLLLYHVGEVTLTFHSDRLSWKLVEPLDNDVSTCLGIKYFSKVATGIKLSDIYAVELNDHGSIHISSLSPATECLFLGQDIKMYSFTVHGFIRSKTQPSQCILVEYTFGHKNLPRCQMWVNQLNASLKHEIGRPKNLLVFVHPRSGKGNGCRTWEAVAPIFSRAKVKTKVIVTERAGEAFDVMSSITNVELNSFDGVVAVNWTGNSCVILYYTENLMVITLNKGGDGFFNEILNGFLSPRFKAPYPPTPSDFVHLAKYNGDSLVLDEDEIVDGTSIRNEDQFPLIPSPKQSGSRISNSNSEDKAAEFPVPNEWFRFGIIPAGSTDAIVICTTGTRDPITSALLIVLGKRVHLDIAQVVRWKRTPTSEVEPNVRYAASFSGYGFYGDVITESEKYRWMGPKRYDYAGTMVFLKHRSYEAEITYVESDETNLTSKRDHEGNLLRAIRSPHKSEKCICRINCKVCNEKPNHASLGVCSLTPHLNSEETRWARSKGRFLSVGAAVISCRNEKAPDGLVADAHLSDGFLHLILIRDCPHASYLWHLTQLTRRGGSPLNYKFVEHHKTPAFTFTSSGNESVWNVDGEIFQAHQLSAQVFRGLVCMFASGPEV

SEQ ID NO: 233112 - protein, 257 aa, Glycine max
  Coding DNA Sequence Number=SeqID_116334
  Gene Ontology: Mol. function=nucleic acid binding; Biological process= DNA integration
MPKNKECKEFIKLVKDCSQSNITDKSIMGNLSKMANLAAKLNSTRMQAWRLKKMKNNSIHLMIHDEASTSKSKPSKKDKDKSHIKVPNNTWWLDSRATTHVSHIMQGFLSIQTIKGIKEFLYIGNRMRARIEGIGTYKLILDIRCHVDLEGCLYVPRCFRNLVYVAKLDELGFSFKIGNNTRGEFSSPKVPHQDVVPFVILHSINTQRQHNIENPEDDEPADNVQFINEQVIEEKQQITPRTKRPERQRRSAICVFA

SEQ ID NO: 233113 - protein, 510 aa, Glycine max
  Coding DNA Sequence Number=SeqID_116335
  Gene Ontology: Mol. function=sugar porter activity; Cellular component=integral to membrane; Biological process=carbohydrate transport
  Homolog annotation: Hit_ID=Q3L7K7; Match level="QueryCoverage=97%, HitCoverage=98%, E-value=0.0, Identity=73%"; Hit description =Putative hexose transporter
  Pfam annotation: Domain name=DUF895; Domain location=66-197; Score= -76.8; E_value=0.039; Accession=PF05978.7; Description=Eukaryotic protein of unknown function (DUF895)
  Pfam annotation: Domain name=MFS_1; Domain location=22-449; Score =94.0; E_value=4.5e-25; Accession=PF07690.6; Description=Major Facilitator Superfamily
  Pfam annotation: Domain name=Sugar_tr; Domain location=25-488; Score =485.0; E_value=9.2e-143; Accession=PF00083.14; Description=Sugar (and other) transporter
  Pfam module annotation: Pfam domain module=DUF895::MFS_1::Sugar_tr; Domain location=66-197::22-449::25-488
MAVGLAITSESGQNNGKITLYVVLSCMMAAMGGVIFGYDIGITGGVTSMEPFLKKFFHKVYLKMKLADDKVSNYCVFDSQLLTSFTSSLYVAGLVTSFFASYITKAFGRKPSIVVGGAAFLAGTGLGGAAFNVYMLIVGRLLLGVGVGFANQAVPLYLSEMALPRLRGAINNGFQLSIGIGALSANLINYGTEKIEGGWGWRMSLAMAAVPASVLTLGALFLPETPNSVIQRSHDKQKAKLMLQRIRGMEDVQAELDDLIKASSPSKTNNKQSLKLILKGRYRPQLVMALAIPFFQQVTGINVIAFYAPLLFRTIGLGESASLLSAVMTGVVGTGSTFISMFVVDKLGRRTLFMIGGIQMFVSQCIVGGIMALHLKDHGGLSKGYAFVVLVMICIYVAGFGWSWGPLGWLVPSEIFPLEIRSAGQSITVAVSFIFTFIVAQTFLSMLCHFRSGIFFFFGGWVVVMTTFVYYFLPETKSVPLEQMEKVWQEHWFWKRIVGEVSDRQHKGEI

SEQ ID NO: 233114 - protein, 367 aa, Glycine max
  Coding DNA Sequence Number=SeqID_116336
  Gene Ontology: Mol. function=asparaginase activity; Cellular component=lysosome; Biological process=glycoprotein catabolic process
  Homolog annotation: Hit_ID=Q56W64; Match level="QueryCoverage=91%, HitCoverage=94%, E-value=1e-140, Identity=71%"; Hit description =Probable L-asparaginase 3 precursor (EC 3.5.1.1) (L-asparagine amidohydrolase 3) ...
  Homolog annotation: Hit description=[Contains: L-asparaginase 3 subunit alpha; L- asparaginase 3 subunit beta]
  Pfam annotation: Domain name=Asparaginase_2; Domain location=28-358; Score=318.2; E_value=1.4e-92; Accession=PF01112.9; Description =Asparaginase
MDESEREGDEFKTQREFCGTMRCRGSFAKVVVGHETVKSEQYPLVVSTWPFIEAVRAAWRAVDAGSSAVDSVVEGCSACEELRCDGTVGPGGSPDENGETTIDALIMDGVTMEVGAVAAMRYVKDGIKAARLVMQHTEHTLLVGEKASEFAISMGLPGPTNLSSPESMEKWAKWKDSRCQPNFRKNVSPANSCGPYRPTNYLGHPDETCSSTVQMLTSNSNLLRVGLHSHDTISMAVIDRMGHIAVGTSTNGATFKIPGRVGDGPIAGSSAYAIDEVGACCATGDGDIMMRFLPCYQVVESMRLGMEPKLAAKDAITRIARKFPDFLGAIVALNKKGEHAGACHGWTFKYSVKSPAMKDVEVFTVLP

SEQ ID NO: 233115 - protein, 103 aa, Glycine max
  Coding DNA Sequence Number=SeqID_116337
  Homolog annotation: Hit_ID=Q07423; Match level="QueryCoverage=37%, HitCoverage=7%, E-value=3e-12, Identity=79%"; Hit description=Hexose carrier protein HEX6
MYMLRAAPPRAAPMRNAAPPMRIDGFRPKALELAIKFAVVANLGVLLHLGVHIWEKFLQKWHHRCYSTCNSCKLVKLIKVYNISDQTEGENLQTYVNAYLLIK

SEQ ID NO: 233116 - protein, 320 aa, Glycine max
  Coding DNA Sequence Number=SeqID_116338
  Homolog annotation: Hit_ID=Q1T1Y0; Match level="QueryCoverage=46%, HitCoverage=37%, E-value=9e-09, Identity=29%"; Hit description =Ankyrin
  Pfam annotation: Domain name=DUF1723; Domain location=181-230; Score =41.6; E_value=2.7e-09; Accession=PF08330.1; Description=Protein of unknown function (DUF1723)
MVRTRGLGRALGRVSGRGLGREDRDDSDDAPQRRRPTASAHRQRVPVTIADAELVVLVVEADVAAIEADVAATEADIATAEAEVVVDESMVEADVHDIGADIAANASAQAAADEPEGFLGGSTDPSVLTEYAEDVAANECLELKLSFHGRKVHNLGRLVPAIEGLVAGTRLSPLIACSVDNDDRGLLSSFVEWWNWETSSFHLLVGEVMITLDDVSSLLHLPVVGDLHTFQPLHVDEARQPGLRPNTVVDRTYACLGYAICISTDVRLYIRQLQLVRIFSIFWVALIFANKSVTHVHVVFLDALCDLSQTGRYAWGVVAL

SEQ ID NO: 233117 - protein, 55 aa, Glycine max
  Coding DNA Sequence Number=SeqID_116339
MKKESPIPNVLSMPNIAQLTSGERPRIAKCGVNITEQRMMCLVSKKDTSGNKIIQ

SEQ ID NO: 233118 - protein, 120 aa, Glycine max
  Coding DNA Sequence Number=SeqID_116340
  Gene Ontology: Mol. function=transcriptional repressor activity; Biological process=regulation of nitrogen utilization
  Homolog annotation: Hit_ID=O49820; Match level="QueryCoverage=79%, HitCoverage=62%, E-value=6e-16, Identity=63%"; Hit description =Isoflavone reductase-like protein
MERFLPSDFGVEEDRVNPFPPFQAVLDKKRKIRREIEAAKIPSLPPLHNIPVSILHSVFVKGDLVNFELGENDLEASQLYPDYNYTSIDQLLDIFLELTKCFSTVIVQSSSSNGICIRHS

SEQ ID NO: 233119 - protein, 101 aa, Glycine max
  Coding DNA Sequence Number=SeqID_116341
MESSAACPLHVILEMVRPLSDPYGSVSRGSDEDTTKGKDYETLEGPMTKGRLKKAQPGDEDTTKGKDHEALEGPMTRGRLKQVQHVIETRLVICITAIDND

SEQ ID NO: 233120 - protein, 349 aa, Glycine max
  Coding DNA Sequence Number=SeqID_116342
  Gene Ontology: Mol. function=transcriptional repressor activity; Biological process=regulation of nitrogen utilization
  Homolog annotation: Hit_ID=Q3KN71; Match level="QueryCoverage=94%, HitCoverage=97%, E-value=1e-115, Identity=63%"; Hit description =Isoflavone reductase-like protein 2
  Pfam annotation: Domain name=Epimerase; Domain location=20-244; Score= -63.2; E_value=0.053; Accession=PF01370.11; Description=NAD dependent epimerasedehydratase family
  Pfam annotation: Domain name=NmrA; Domain location=20-328; Score =397.1; E_value=2.6e-116; Accession=PF05368.3; Description=NmrA-like family
  Pfam module annotation: Pfam domain module=Epimerase::NmrA; Domain location=20-244::20-328
MNLQEIEESTKENMERKNRILVFGGTGYIGKYLVRASVSLGHPTLVYTRPLNAQTPPSKAQVCKEFNSIGVTLVHMIYVVEARFHFPNEFELKVQGELEHEQILAVIKQVDIVICALASPQVMEQLKIIDAIKVAGNIKRFIPSGFGAEEDSVKPLPPFQAVLDKKRKIRREIEAAGIPYTSISANCFGAYFVNYLLHPYENVKDITVYGNGEAKAVLNYEEDIAMYTVKAANDPRTCNRVVIYRPQKNIISQNELTSLWEQKCGQTFHKAFISEEEIVKLSQSLPSPHNIPVSILHSIFVKGDLVRFEIEEDDLEASQLYPDYNYTSIDQLLDIFLVDPPPPASAAFE

SEQ ID NO: 233121 - protein, 46 aa, Glycine max
  Coding DNA Sequence Number=SeqID_116343
MIKESKDLASMLMEALFGKFLEYEHGLIRQSHVEDTKKKRKGISLK

SEQ ID NO: 233122 - protein, 100 aa, Glycine max
  Coding DNA Sequence Number=SeqID_116344
  Subcellular localization annotation: CTP_CleavageSite=35; ConfidenceScore=5.09e-01
MSPPPLETSQSLKISSKAPQDGFLFKLSSLLVSPQLKTLKKNLTPSEIPEGEDDALSELAFAQCLYTAHPSSRIVHALSHQMGRLVDDALSQKMSGLASS

SEQ ID NO: 233123 - protein, 681 aa, Glycine max
  Coding DNA Sequence Number=SeqID_116345
  Gene Ontology: Mol. function=nucleoside-triphosphatase activity; Cellular component=nucleus; Biological process=protein transport
  Homolog annotation: Hit_ID=Q9LZF6; Match level="QueryCoverage=98%, HitCoverage=82%, E-value=0.0, Identity=85%"; Hit description=Cell division control protein 48 homolog E
  Pfam annotation: Domain name=AAA; Domain location=114-298; Score =329.5; E_value=5.9e-96; Accession=PF00004.19; Description=ATPase family associated with various cellular activities (AAA)
  Pfam annotation: Domain name=AAA; Domain location=387-574; Score =340.5; E_value=2.8e-99; Accession=PF00004.19; Description=ATPase family associated with various cellular activities (AAA)
  Pfam annotation: Domain name=AAA_2; Domain location=110-239; Score= -23.6; E_value=0.00056; Accession=PF07724.4; Description=ATPase family associated with various
  Pfam annotation: Domain name=AAA_5; Domain location=114-246; Score =11.7; E_value=0.00023; Accession=PF07728.4; Description=ATPase family associated with various
  Pfam annotation: Domain name=Arch_ATPase; Domain location=91-256; Score=-96.1; E_value=0.06; Accession=PF01637.9; Description=Archaeal ATPase
  Pfam annotation: Domain name=ResIII; Domain location=95-226; Score= -39.4; E_value=0.093; Accession=PF04851.6; Description=Type III restriction enzyme, res subunit
  Pfam annotation: Domain name=Sigma54_activat; Domain location=80-242; Score=-175.0; E_value=0.0063; Accession=PF00158.16; Description=Sigma- 54 interaction domain
  Pfam annotation: Domain name=Vps4_C; Domain location=591-644; Score= -13.5; E_value=0.027; Accession=PF09336.1; Description=Vps4 C terminal oligomerisation domain
  Pfam module annotation: Pfam domain module=AAA::AAA::AAA_2::AAA _5::Arch_ATPase::ResIII::Sigma54_activat::Vps4_C; Domain location=114- 298::387-574::110-239::114-246::91-256::95-226::80-242::591-644
MEKLHLFSSPASYFLEAYRPVRKGDMFLVRGGMRSVEFKVIETDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRENPEAMEEDIEEEEVAEIKAAHFEESMKYARRSVSDADIRKYQAFAQTLQQSRGFGSDFTFANTSSVGAAAGAGAASDPFASAGGADEDDLYS

SEQ ID NO: 233124 - protein, 96 aa, Glycine max
  Coding DNA Sequence Number=SeqID_116346
MTGNELSSSFVYSTQGELKPSKAWLGLTHFHPYMWRSLLFSWLFGYGGYCVRSVKGGPSVWMSGSNYLAGCGRALHDHGGCRSKIVNEGRSVSWRR

SEQ ID NO: 233125 - protein, 108 aa, Glycine max
  Coding DNA Sequence Number=SeqID_116347
  Homolog annotation: Hit_ID=Q2QNG6; Match level="QueryCoverage=60%, HitCoverage=62%, E-value=3e-19, Identity=65%"; Hit description =Expressed protein
MGLGFVVGFLGLLILFHAAYSTIQYKGLLKITEEEFSGPPLNVVIEVTLGLVFCMWAALTVPGKFLSIHPHSEENRFDSSECEFELVVDLIVLMLLLCCLGERTESLK

SEQ ID NO: 233126 - protein, 668 aa, Glycine max
  Coding DNA Sequence Number=SeqID_116348
  Gene Ontology: Mol. function=oxidoreductase activity; Cellular component=periplasmic space; Biological process=electron transport
  Homolog annotation: Hit_ID=O48552; Match level="QueryCoverage=98%, HitCoverage=96%, E-value=0.0, Identity=60%"; Hit description=Copper amine oxidase precursor
  Pfam annotation: Domain name=Cu_amine_oxid; Domain location=258-668; Score=603.8; E_value=1.5e-178; Accession=PF01179.10; Description =Copper amine oxidase, enzyme domain
  Pfam annotation: Domain name=Cu_amine_oxidN2; Domain location=36-126; Score=106.8; E_value=6.4e-29; Accession=PF02727.6; Description=Copper amine oxidase, N2 domain
  Pfam annotation: Domain name=Cu_amine_oxidN3; Domain location=132 -229; Score=137.4; E_value=3.8e-38; Accession=PF02728.6; Description =Copper amine oxidase, N3 domain
  Pfam module annotation: Pfam domain module=Cu_amine_oxid::Cu_amine _oxidN2::Cu_amine_oxidN3; Domain location=258-668::36-126::132-229
AVENMIRRFGKAVPMIVQCFILVLSLKFISVNCLAHPLDPLSPAEINKTRDIVQGSYLGAIPNITYHFVDAEEPDKKRVLEWLSSNSKEDKPIIPRQAKVVVRAKGETHELVVDLTKKSIVSDKIYTGHGYPPFTFNELFQASKLPLTYPIFKSSIAKRGLNLSEVSCVPFTLGWYGEKITSRALKVSCFYRGGSVNVWARPIEGITVLVDVDSMQITMYNDRYIAPLPKAEGTDFQSSSSNSNSRPKTSSSASCNVTDIIGFTIKGNEVKWANWVFHVGFNARAGMIISTASIFDAKRQKYRSVLYRGHVSETFVPYMDPTEEWYFRTFMDAGEFGFGRAADTLQPRVDCPSNAVYMDGYMAGPNGEVQQVPRAICIFERNSGNVAWRHMEINNPQKLVRNGEPEITLVVRMVATVGNYDYVLDWEFLRSGSIKVGVDLTGIMEMKAVPYTEKSEIKERVFGTLVAENTIANYHDHHITYYLDLDIDDNSNSFINAKLQRARATGFGTPRKSYWTVVREIAKREAEGRIRLGLEPAELLIVNPNKRTKLGNEVGYRLISAQPITSLLSDDDYPQRRASYTKYQLWVTSYNRSERWAGGFYADRSRGDDGLAVWSQRNREIENTDIVLWHTIGIHHVPYQEDFAAMPAIHGGFELRPANFFESSPLLE

SEQ ID NO: 233127 - protein, 62 aa, Glycine max
  Coding DNA Sequence Number=SeqID_116349
MSLQIWVGVERGCKRLADANVCEKLLQLFRMCETSPHDFPWHGSSVDSCWYPRRFLGLVMIE

SEQ ID NO: 233128 - protein, 70 aa, Glycine max
  Coding DNA Sequence Number=SeqID_116350
MEKYFGNAYRGDPGVPHSDPDRFVNIWVGSAAFAVLTYFNPYMWQLSNQFKYQLSFPSFQLIQTSIIDAA

SEQ ID NO: 233129 - protein, 508 aa, Glycine max
  Coding DNA Sequence Number=SeqID_116351
  Homolog annotation: Hit_ID=Q2R9D1; Match level="QueryCoverage=59%, HitCoverage=37%, E-value=1e-27, Identity=31%"; Hit description =Expressed protein
  Pfam annotation: Domain name=DUF616; Domain location=100-457; Score =481.0; E_value=1.4e-141; Accession=PF04765.4; Description=Protein of unknown function (DUF616)
  Subcellular localization annotation: CTP_CleavageSite=70; ConfidenceScore=5.42e-01
MGRLIRTSKPLIFHSKLLCFSLFYLFTTLFLALYTSLSQSKCFFRSSPSDPVQNSLFSYPSSYGEHKYAVSTTRSTCSSPVFFSDYSDVVKEIKNCRNNNVGYSGALRYMQGNLDSFGGNLNTLSRFSYFDHQNDSTEVPCGFLKKFPISDSDRIAMEKCDSVVVVSAIFNDHDKIRQPKGLGSNTLQEVCFFMFVDDVTLKGLEHHGLVSINSREYKIGVWRIVKVAKENLYQNPAMNGVIPKYLVHRLFPHSHFSIWIDAKLQLMVDPLLLIHSLVISKNVDMAISKHPYYVHTMEEAMATARWKKLLDVNALKEQMETYCENGLQPWSPNKQPYVSVTIWESVTAFISLRNVRTFAPPLTINIIWYVSLAMSLVVKACDYKVSSIWDVPDSALILRRHGLGSNLFSCLIFNELQAFNPRDQLPFAFVRDHMKPNLKLNMFEVEVFEQVAVEYRHNLKSSDGTTVKKVFSSGRTKRAHPDLLYVNGSCCSKCQKYLSIMWGESSND

SEQ ID NO: 233130 - protein, 158 aa, Glycine max
  Coding DNA Sequence Number=SeqID_116352
  Gene Ontology: Mol. function=protein binding; Cellular component =nucleus
  Homolog annotation: Hit_ID=Q2R1S6; Match level="QueryCoverage=88%, HitCoverage=98%, E-value=6e-36, Identity=52%"; Hit description =Expressed protein
  Pfam annotation: Domain name=DUF538; Domain location=4-151; Score =132.2; E_value=1.4e-36; Accession=PF04398.3; Description=Protein of unknown function, DUF538
MATAKIEHHREEAEIYEGEAVCTQKSRLLLDEILLPRGLLPLENIVEMGYNRTTGFVWLKQRHKKEHRFATIGRTVSYATEVTAFVEEHRMRRVTGVKTKELFIWVSISEIFVDDPASGKITFANSSGIARSFPLSAFSLQEEHQQQQQEHDHAETLA

SEQ ID NO: 233131 - protein, 246 aa, Glycine max
  Coding DNA Sequence Number=SeqID_116353
MKKFINSNYGKISCTILAAGGLSLLIYVLKRWPKPKPKPETEPTLGPKSEPQSMPKLGPKSVSIFLRELHGGYRAWNRLETETYKEAQISSAPDSAGALQQELQKELPDLMILQQNVEDLENSEKEGVAENILAQALKKASDKPHEAYEIEMLLVEVLIYKGGKQDLETALKCKCLKDESLKDARRPLFKAIIYQMLGSIKEAKQHWDEFIVVRDPAFRREIDFDHFKRHVDRLLQANARQNHENS

SEQ ID NO: 233132 - protein, 261 aa, Glycine max
  Coding DNA Sequence Number=SeqID_116354
  Gene Ontology: Mol. function=zinc ion binding; Cellular component =intracellular
  Homolog annotation: Hit_ID=Q6H889; Match level="QueryCoverage=88%, HitCoverage=98%, E-value=2e-58, Identity=50%"; Hit description =Putative zinc-binding protein
  Pfam annotation: Domain name=PLATZ; Domain location=44-154; Score =256.0; E_value=7.9e-74; Accession=PF04640.4; Description=PLATZ transcription factor
MVVNSVHSPGANTDQNSNCKFVSSSSHVPRWLQVLLTEKFYNVCIIHEEAKKNEKNVYCLDCCISLCPHCLSPHRSHRLLQIRRYVYHDVIRLDDAAKLIDCNSVQSYTTNSAKVVFLNQRPQTRNFRGSGNFCSTCDRSLQDPYHFCSLSCKINYLVRTTDSLCGYLFECNYLPLLESGLDDGLMMTPDSVLEPSGSGGYGGVDCRTTLACTATTEIVRKKRTGGAAFRLPFRPACSPVSEISACLMNRRKGNPQRAPLH

SEQ ID NO: 233133 - protein, 216 aa, Glycine max
  Coding DNA Sequence Number=SeqID_116355
  Gene Ontology: Mol. function=transporter activity; Cellular component= intracellular; Biological process=transport
  Homolog annotation: Hit_ID=Q10PW5; Match level="QueryCoverage=97%, HitCoverage=42%, E-value=6e-60, Identity=55%"; Hit description =CRAL/TRIO domain containing protein, expressed
  Pfam annotation: Domain name=CRAL_TRIO_N; Domain location=2-75; Score= 4.8; E_value=0.015; Accession=PF03765.5; Description=CRALTRIO, N -terminus
MGKKTELKDHKETTKVEAVLELLRKQTPLTVKQEKFCNYACVKRFLKAKGDNVKKAAKQLKACLAWRESVITDHLIADDFSAELADGLAYVSGHDDESRPVMIFRLKQDYQKLHSHKMFTRLLAFTLEVAISTMPKNVEQFVILFDARPEGHTESVRSAPEESPINGHIREGFYRSASAFMNLLLPALKIVAEYYPGRLCKAFVIDPPSLFAYLWK

SEQ ID NO: 233134 - protein, 612 aa, Glycine max
  Coding DNA Sequence Number=SeqID_116356
  Gene Ontology: Mol. function=RNA-directed DNA polymerase activity; Cellular component=chromatin; Biological process=chromatin assembly or disassembly
  Pfam annotation: Domain name=RnaseH; Domain location=308-429; Score= -12.2; E_value=0.0008; Accession=PF00075.14; Description=RNase H
  Pfam annotation: Domain name=zf-H2C2; Domain location=477-518; Score =8.9; E_value=0.024; Accession=PF09337.1; Description=His(2)-Cys(2) zinc finger
  Pfam module annotation: Pfam domain module=RnaseH::zf-H2C2; Domain location=308-429::477-518
MGDGHTTETSGMCKEIKIETEAGRFTLDAVLFDLEDIDVILGMSWLKTLGVMTVDWNTQIMKFETELGTKTLRGVNQEESLFATLCGGLPPVRVKEHTIKLKQGHDPINVRPYRYSYHQKNEIEKQVKELLEIGHIRPSQSEYSSPVILVKKKNNKWRMCVDYRALNKATVPDKFPIPVIEELLDEFHGSTYFSKTHEGHYEYLVMRFGLMNAPSTFHSLMNEQLKCVLEVLRKQQLYANKEKCNFGQRSIEYLGHVISKQGVEVDPNKVKSVLDWPVPTNVKGAQKAFEELKNKITSVPVLTLPNFEQEFELECDASGLGIGAILMQSRKPVAYFSKALSSRNVTKSAHERELMAVALAIQHWCPYLLGRKFTVYSDQKSLKQLLQQRITTGSQQNWLAKLLGYNFEIVYKPGLENKGADALSRSMGEMELNSLAYIPVIEDLKQDQGKHGVLFFKDRLVVAETSSWIPKLMEEFHATPQGGHSGFYRTYRRLASNLFWKGMKGDIMRFVQDCDVCQRQKYLTTAPRGLLQPLPIPNQVWEDISLDFITGLPRSKGFEAILVVVDRLSKYSHFIPLRHPYTARAIAEIFVKEAIRFHGVPNSVVSDRDPLL

SEQ ID NO: 233135 - protein, 241 aa, Glycine max
  Coding DNA Sequence Number=SeqID_116357
  Gene Ontology: Cellular component=chloroplast
  Homolog annotation: Hit_ID=Q00SL9; Match level="QueryCoverage=66%, HitCoverage=62%, E-value=2e-49, Identity=60%"; Hit description =Homology to unknown gene
  Subcellular localization annotation: CTP_CleavageSite=33; ConfidenceScore=5.70e-01
MMMAHSHYLLHIPSLSSLSASLTSPPRSLLPVRTLQPKTLSCRVPSFPTRTPWHFKPLHFALSGALSLGLLFGVVELKLKVSNFVGIGVAEAAKVGVNKPELLPKEFSTVIDVAGFLSDGQEKRLAEEIAALEADTGFKLRVLAQNYPVTPGLAIKDFWQVDDRTVVFVADPTFGNILNFNVGATVDLDVPRSFWNRLAGKYGNIFYWKEKGEDASIEAAVMAISSCLREPVGPNNCSEVN

SEQ ID NO: 233136 - protein, 196 aa, Glycine max
  Coding DNA Sequence Number=SeqID_116358
  Gene Ontology: Mol. function=RNA-directed DNA polymerase activity; Cellular component=mitochondrion; Biological process=RNA-dependent DNA replication
  Homolog annotation: Hit_ID=Q9FJR9; Match level="QueryCoverage=84%, HitCoverage=22%, E-value=3e-42, Identity=49%"; Hit description =Similarity to maturase-related protein
GTHYNIRIHAVQNLSQVPFEEPQIPCEVAPNGSNNRVGVSTGSKRVRFRGEPGFKNRFENHQENLLNDAVLEAGLAGLDSGAEFAFGEGLGNGGVVGGAEERVGFVVPFETVADDGVAEGEEGVEDGGVDGVTGREGAGGVGAGALVSEEPEVEVGEEAGSEGLGFGSVVARNELKMDARRKRVCCDGTESVRRFS

SEQ ID NO: 233137 - protein, 45 aa, Glycine max
  Coding DNA Sequence Number=SeqID_116359
DGGGYNCHYDMVILNPIPTGHFFNYFLPRTEKSHCFLSCHLALSM

SEQ ID NO: 233138 - protein, 230 aa, Glycine max
  Coding DNA Sequence Number=SeqID_116360
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=64%, HitCoverage=11%, E-value=2e-26, Identity=40%"; Hit description=Chromo
EVKVEVVQRELQDRDEALRQLKNLLARAQERMKTQADKHRKEMNFEIGDLVFLKLKQHRQHSVAARISPKLSARYYGPFEVIERIGEVAYKLKLPTTHEDYKVESTLPSGLEDDREGEIEPELGKSVDEATWEDELTLKSQFPELSLEDKTLLQGESVDRNQIRNGPLEPLVHEMQKGPRECRQFVTGESGQLATGESGREASPGAAVKLCLGDLLVMGSNPETASLHMQ

SEQ ID NO: 233139 - protein, 70 aa, Glycine max
  Coding DNA Sequence Number=SeqID_116361
MCLTRFMFFGLDNKVPEFQTQDIGTKLSHEPGPRKIKKEKGYEGVKEFHFEKLLHHGQNVKSGRRHSSQV

SEQ ID NO: 233140 - protein, 145 aa, Glycine max
  Coding DNA Sequence Number=SeqID_116362
  Gene Ontology: Mol. function=protein dimerization activity; Cellular component=nucleus; Biological process=regulation of transcription, DNA-dependent
  Homolog annotation: Hit_ID=Q2IB38; Match level="QueryCoverage=60%, HitCoverage=8%, E-value=7e-35, Identity=68%"; Hit description =Cellulose synthase 6
  Pfam annotation: Domain name=C1_3; Domain location=44-77; Score=7.3; E_value=0.071; Accession=PF07649.3; Description=C1-like domain
  Pfam annotation: Domain name=PHD; Domain location=45-94; Score=6.9; E_ value=0.012; Accession=PF00628.19; Description=PHD-finger
  Pfam annotation: Domain name=zf-C3HC4; Domain location=46-91; Score =3.7; E_value=0.065; Accession=PF00097.15; Description=Zinc finger, C3HC4 type (RING finger)
  Pfam module annotation: Pfam domain module=C1_3::PHD::zf-C3HC4; Domain location=44-77::45-94::46-91
MVKRKTLCYCVIRKYGSHNSNEFIIIRQDGDFAQRELQPLLHGKICQLCGDDIGVNEDGDLFVACNECAFPVCKSCYEYERREGNQVCPQCKTRFKRLKGCARVEGDEEEDIDDDLENEFDFDDGQSKLHDMKTSMSHEVMLNSK

SEQ ID NO: 233141 - protein, 141 aa, Glycine max
  Coding DNA Sequence Number=SeqID_116363
  Homolog annotation: Hit_ID=Q287W3; Match level="QueryCoverage=58%, HitCoverage=6%, E-value=8e-18, Identity=45%"; Hit description=SNF2 domain-containing protein
MAHRKRRLDQLKHPFSPHPFEAVAFGSWQAVEFIKIEGGTMSMHFVDNHHMVMEKGPLSDIRIRSRNATLSDCSRFLRPGIDVCVLSAPQQSDDADAINIDPNIVNGSIWQKMEIPPYKHAIVAYGATIVGLPSQIVYGRG

SEQ ID NO: 233142 - protein, 72 aa, Glycine max
  Coding DNA Sequence Number=SeqID_116364
  Homolog annotation: Hit_ID=Q6XZC2; Match level="QueryCoverage=68%, HitCoverage=4%, E-value=4e-12, Identity=64%"; Hit description =Cellulose synthase 6
MDPSKDLAAYGYGSIAWKEKMKIWKQRQMKISDMKKENDNEDPDNTVEDDDTEFLIHNTFHSHIVKSLKHVD

SEQ ID NO: 233143 - protein, 1230 aa, Glycine max
  Coding DNA Sequence Number=SeqID_116365
  Gene Ontology: Mol. function=nucleic acid binding; Cellular component= nucleus; Biological process=regulation of transcription, DNA-dependent
  Homolog annotation: Hit_ID=Q1S136; Match level="QueryCoverage=99%, HitCoverage=92%, E-value=0.0, Identity=52%"; Hit description=SNF2 -related; ATP-requiring DNA helicase RecQ
  Pfam annotation: Domain name=DEAD; Domain location=650-864; Score= -46.1; E_value=0.044; Accession=PF00270.19; Description=DEADDEAH box helicase
  Pfam annotation: Domain name=Helicase_C; Domain location=1070-1149; Score=55.1; E_value=2.4e-13; Accession=PF00271.21; Description =Helicase conserved C-terminal domain
  Pfam annotation: Domain name=ResIII; Domain location=646-858; Score =2.1; E_value=3.1e-05; Accession=PF04851.6; Description=Type III restriction enzyme, res subunit
  Pfam annotation: Domain name=SNF2_N; Domain location=652-1002; Score =7.4; E_value=1.6e-08; Accession=PF00176.13; Description=SNF2 family N-terminal domain
  Pfam module annotation: Pfam domain module=DEAD::Helicase _C::ResIII::SNF2_N; Domain location=650-864::1070-1149::646-858::652 -1002
VWADAKISSVQRKPHDSECSCQFYVNFYVHQGSLGAELRTLSREIKVVGINQISILQKLESTPCENQHYRWASSEDCSIISHTKLLLGKVLCDLSWLVVTTALKKVSICVRSLQDKLVYQVLGRDTVSTSLNNESHIDVVNFKTDKGMLVPIVSQVATLKTKRVDPEQESHEDKESPSYNVEGLRRSKRRNVQPERYLGCEKVSQIDVGSFRNLPPVKIDTWKDNDIDHEMYIPLAGLFRWQKKCLEGDTDNHQKVKKVSTCRELVVYKRKKTKSQKVRSGGDDQNEHQNHLAIIPLPAQHDPVEVIHCDDLYDKVTRSYGNESSEISSKYHHLTGTTSKKNDVKLLTFESHYHAAKSDDGEKSDDLSWRYHYSYGAPKSQRKGLSDLDDMVNLGNKWEGISSSKVVKGKKHRTTYFGSRDHGEEKRYNYKDRSLNAAAYKDLINSYLKNINTRPTNEEPAIADQWKQTETPSSIGQKTETEVLRKEEAEEESEMDMLWRELEVSLASCYLEEDTEANSVQLFNQDSNAAVFTETLENPNAGCPHDFRMNEEIGIYCYRCGFVSTEIKYITPPFLVICSNPETVALHMHGIQHSVWHQEEKQIPEEDSKTKANEDDDIDLLPALDSPEKPVSQENDNVWVLIPELKAKLHAHQKKAFEFLWQNIAGSMDPGLMEAASKRRGGCVVSHTPGAGKTFLIIAFLVSYLKLFPGKRPLVLAPKTTLYTWYKEFIKWDIPIPVYLIHGRRTYRVFKQKSSIVIPGVPKPTDDVKHVLDCLEKIQKWHSHPSVLIMGYTSFLTLMREDSKFAHRKYMAKVLRESPGVMVLDEGHNPRSTKSRLRKVLMKVQTELRILLSGTLFQNNFCEYFNTLCLARPKFIHEVLKALDPKYKRKGKVAKKASHLLESRARKFFLDQIAKKIDSSNGRERRKGLKMLRNVTNGFIDVYEGGSSDGLPGLQIYTLLMNSTDTQHEILHELHKKMAKVNGYPLELELLITLGSIHPWLVKSAVCAEKFFTQAQLMELEKCKFDLRIGSKVKFVLSLIYRVVKKEKVLIFCHNIAPVKLFVEYFEKYFGWTKGREVLVLTGELELFERGRVMDKFEEPGGVAKILLASITACAEGISLTAASRVIMLDSEWNPSKTKQAIARAFRPGQQKVVYVYQLLVTGSLEEDKYKRTTWKEWVSSMIFSEAFVEDPSQWQAEKIEDDILREMVAEDRSKSFHMIMKNEKASTNK

SEQ ID NO: 233144 - protein, 323 aa, Glycine max
  Coding DNA Sequence Number=SeqID_116366
  Homolog annotation: Hit_ID=UPI00005DC273; Match level="QueryCoverage =96%, HitCoverage=47%, E-value=3e-45, Identity=34%"; Hit description =hydrolase, acting on glycosyl bonds
MSPFFVTFRDAVIIFQLMETKYQMLLGAIFLPKVFSLKEASYSGGGNITFKGSLEKDTYLKRRIFQGEFTLSELPIHFFYSVKSDSNSSLGLVLEFTSTINKAMSILLTSHGMDHLSSGFSKVVPTSEHKGNAPGWVIHEGTIEMNGYILTGIHALCYRPNAPFKELKSRPFGPDYTVPSSTDYSAVLGHITVKTSNYKPDFPVSTSWLVDGEYINWKSGPQDSRILSVKISWELKEGKNFAFPHYNVYVEKIPKLAGGNSGTTIEHVQEYLGVAHVNCFYVSELKVPASISNLKFIIQVCSFDGTNQNLEDCPYYQLEIKGL

SEQ ID NO: 233145 - protein, 67 aa, Glycine max
  Coding DNA Sequence Number=SeqID_116367
MVVVSHHELYVLLHLFLGGVIATDEDRVIIAAEGNIIVREDLVDIPGFTLPEDLSGNCIVHPVKITP

SEQ ID NO: 233146 - protein, 191 aa, Glycine max
  Coding DNA Sequence Number=SeqID_116368
  Gene Ontology: Mol. function=hydrolase activity, acting on glycosyl bonds; Cellular component=intracellular; Biological process =metabolic process
  Homolog annotation: Hit_ID=Q9FLA9; Match level="QueryCoverage=92%, HitCoverage=27%, E-value=8e-73, Identity=70%"; Hit description =Similarity to endo-beta-N-acetylglucosaminidase
  Pfam annotation: Domain name=Glyco_hydro_85; Domain location=1-158; Score=65.7; E_value=1.5e-16; Accession=PF03644.4; Description =Glycosyl hydrolase family 85
MHSSVTGSLVIWYDSVTINGDLWWQNELNEYNKSFFDICDGIFTNYSWQEDYPWRSASVAGDRKFDVYMGIDVFGRGTYGGGQWNTNVALDVIRKADVSAAIFAPGWVYETKQAPDFKTAQNRWWGLVEKSWGIVRKYHGTLPFYTNFDQGHGYHISVDGDQVSDATWCNISSQSIQWPLYKRNLHTIFTT

SEQ ID NO: 233147 - protein, 499 aa, Glycine max
  Coding DNA Sequence Number=SeqID_116369
  Gene Ontology: Mol. function=protein binding; Cellular component =membrane; Biological process=defense response
  Homolog annotation: Hit_ID=Q1SW22; Match level="QueryCoverage=99%, HitCoverage=61%, E-value=1e-165, Identity=56%"; Hit description =Disease resistance protein; AAA ATPase
  Pfam annotation: Domain name=LRR_1; Domain location=339-360; Score =10.2; E_value=3.6; Accession=PF00560.23; Description=Leucine Rich Repeat
  Pfam annotation: Domain name=LRR_1; Domain location=362-383; Score =10.9; E_value=2.6; Accession=PF00560.23; Description=Leucine Rich Repeat
  Pfam annotation: Domain name=LRR_1; Domain location=385-406; Score =6.4; E_value=18; Accession=PF00560.23; Description=Leucine Rich Repeat
  Pfam annotation: Domain name=NB-ARC; Domain location=2-292; Score =120.8; E_value=3.9e-33; Accession=PF00931.13; Description=NB-ARC domain
  Pfam module annotation: Pfam domain module=LRR_1::LRR_1::LRR_1::NB -ARC; Domain location=339-360::362-383::385-406::2-292
MSSLFIKETEILVLELPIDELVGWLLKGTEEHTVISVVGMGGLGKTTLAKHVFYSEIVKSHFHCRACIKVSQSYTMRGLLIDMIKQFCRETNDRLPQMLQEMDEKSLISKVRQYLKQKRYLIFFDDVWHEDFCDQVEFAMPNNNKSSRIIVTTRVRHVAEFFKKSFLVHVHNLQPLLPDKAWELFCKKAFRFEPDGHFPGELEGISNEIFRKCKGLPMEIVAIGDLLPTKSKTAKEDYSIHHNRLTRQWIAEREVRSCQVHDLLHEVIIAKAKDLNLCHFVHGRDESGTSRITRRLSIDTSSNNVPKSSNNTHIRAIHAFGKGGLLEPFMMGQLSSKSRLKVLELEGTSLNYAPSNLGNLFHLRYLNLRSTKIRVLPTSVDKLQNLETLDIRDTFVHELLSEINKLKKLRHLFAFYRNYQAGFSVLGFTTGVLMKKGIKNLTSLENLTHVEVDHGGINRSHPRDEHVKAVKEVRLEVCSEGTWKCNMCFSGRDDTPGIT

SEQ ID NO: 233148 - protein, 65 aa, Glycine max
  Coding DNA Sequence Number=SeqID_116370
  Homolog annotation: Hit_ID=Q1SW19; Match level="QueryCoverage=84%, HitCoverage=5%, E-value=6e-14, Identity=62%"; Hit description =Disease resistance protein
MSHLKKVSSGIKALENLKVLDFISMPTEFVESIVPENGPDYQIINHVPLVFVRHWIGPKVLGDAH

SEQ ID NO: 233149 - protein, 69 aa, Glycine max
  Coding DNA Sequence Number=SeqID_116371
MWGVILTGKNILLELTSSIVLVLSHEFSDLGLGTLCVCLGIRRNEEYELLRRNFSDIGCLGFGIQEHID

SEQ ID NO: 233150 - protein, 64 aa, Glycine max
  Coding DNA Sequence Number=SeqID_116372
  Gene Ontology: Mol. function=catalytic activity; Biological process =folic acid and derivative biosynthetic process
  Homolog annotation: Hit_ID=Q6K2P4; Match level="QueryCoverage=95%, HitCoverage=15%, E-value=1e-16, Identity=67%"; Hit description =Methylenetetrahydrofolate dehydrogenase-like
  Pfam annotation: Domain name=THF_DHG_CYH_C; Domain location=2-61; Score=-75.6; E_value=2.2e-05; Accession=PF02882.9; Description =Tetrahydrofolate dehydrogenasecyclohydrolase, NAD(P)-binding domain
MVETSKTEGDPSGHGFCVSGDVCFEEAVKVASAITPVPGGVGPVTISMLLSNTLDSVKRAFGMV

SEQ ID NO: 233151 - protein, 359 aa, Glycine max
  Coding DNA Sequence Number=SeqID_116373
  Gene Ontology: Mol. function=catalytic activity; Cellular component =cytoplasm; Biological process=folic acid and derivative biosynthetic process
  Homolog annotation: Hit_ID=Q6K2P4; Match level="QueryCoverage=70%, HitCoverage=62%, E-value=7e-75, Identity=51%"; Hit description =Methylenetetrahydrofolate dehydrogenase-like
  Pfam annotation: Domain name=THF_DHG_CYH; Domain location=90-220; Score=128.7; E_value=1.6e-35; Accession=PF00763.13; Description =Tetrahydrofolate dehydrogenasecyclohydrolase, catalytic domain
  Pfam annotation: Domain name=THF_DHG_CYH_C; Domain location=223-355; Score=160.9; E_value=3.4e-45; Accession=PF02882.9; Description =Tetrahydrofolate dehydrogenasecyclohydrolase, NAD(P)-binding domain
  Pfam module annotation: Pfam domain module=THF_DHG_CYH::THF_DHG_CYH _C; Domain location=90-220::223-355
MKSKQIQSQNSEEQDTWNLLLKTQSIKTSTETDIIHNTRTRCATDGVVAWHRTLRKALHSFSAPTSCILAPTSLMFGFPESTHPLTPFFQKVSNIKLEVADEIRRMKSGIGKFPRLAVVLVGDRRDSHTFIHIKLKACDQVGIETVASQLPENCDESELLDVVSGFNEDPDVHGILVQLPLPQFCEVDVDTNALVILTYLMQHLDEEKIINVVSLEKDVDGFHPLNIGNLAIRGRKPFFVPCAPKGCIELLPRHGVEIKGKRAVIIGRSKIVGLPTSLLLQRHHATVSVLHAYMKNPEHITSEADIVVVDVGVPNIVCGNWIKKGAVVIDMGTNQVKVCYNEVLEIFILLFQELGALSK

SEQ ID NO: 233152 - protein, 671 aa, Glycine max
  Coding DNA Sequence Number=SeqID_116374
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=75%, HitCoverage=91%, E-value=0.0, Identity=66%"; Hit description =Retinoblastoma-binding protein-like
  Pfam annotation: Domain name=Prefoldin_2; Domain location=14-119; Score=109.3; E_value=1.1e-29; Accession=PF01920.10; Description =Prefoldin subunit
  Pfam annotation: Domain name=WD40; Domain location=150-187; Score =28.1; E_value=3.1e-05; Accession=PF00400.22; Description=WD domain, G-beta repeat
  Pfam annotation: Domain name=WD40; Domain location=194-231; Score =22.5; E_value=0.0015; Accession=PF00400.22; Description=WD domain, G- beta repeat
  Pfam annotation: Domain name=WD40; Domain location=343-380; Score =14.0; E_value=0.55; Accession=PF00400.22; Description=WD domain, G -beta repeat
  Pfam annotation: Domain name=WD40; Domain location=462-500; Score =22.9; E_value=0.0012; Accession=PF00400.22; Description=WD domain, G- beta repeat
  Pfam module annotation: Pfam domain module=Prefoldin_2::WD40::WD40::WD 40::WD40; Domain location=14-119::150-187::194-231::343-380::462-500
MAKAEGGKEPVNEQAVANMYAAMRSELNQIYSKITELEMEVSEHTLVTNAIQPLDQSRRCYRMIGGVLVERTIKEVLPAVQRNKEGLEEVVARLNEALEKKKKEISEFEAKYKIRIRKADAEVKDESGRKEGSAQGVLVGPADPLQGDFPEVIEEYLEHGCMKCIAFNRRGTLLAAGCNDGSCVIWDFETRGIAKILRDDECSSPITSICWSKYGHRILVSAADKSLILWDVMSGKKITRIVLQQTPLQARLHPGSSTPSLCLACPLSCAPMIVDLNTGDTTLLKVSVSETCNGPTPPSRNKCSDGITSFTPTAACFNKYGTLVYVGNSKGEILVIDYKNGDVHAVVPISGGSVIKNIVFSRNGQYLLTNSNDRIIRIYENLLPLKDEVRALDDLSGNHNDLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVDEDEEVDIVTVEKDATFSDSDMSQEELCYLPSTPSRDVPEQQEKCVESSSKLLDSNNTGSPLSEEAGPNGHMMNHASSPLEDDAGRMKRKRKPSEKVLELQAEKVKKPSKSSKSEKPKSKSLADQDN

SEQ ID NO: 233153 - protein, 262 aa, Glycine max
  Coding DNA Sequence Number=SeqID_116375
  Homolog annotation: Hit_ID=Q9LUV6; Match level="QueryCoverage=59%, HitCoverage=49%, E-value=3e-28, Identity=47%"; Hit description =Arabidopsis thaliana genomic DNA, chromosome 3, P1 clone: MCB17
  Subcellular localization annotation: CTP_CleavageSite=94; ConfidenceScore=5.73e-01
MAGGNHPKSSHHNKPPPSASHRKSRWEPNSSSANSPADPKSKSSTAPSPKPKSNTNPNPSPKHLPFPFPDPAPLGPPPPPAYGFHMLERRTIVLADGSVRSYFALPPDYQDFAPRPLDLPPRFCLPDYSYTAAAAKRKYGDDDGGPRDDLARQREQLLRNANGISREQFSAGPSDLRPSKHSRLDGLSNSTRHSQVDQDALKKSFCNFSKLINENVSQKRTCLEDGKQGRLHCLACGTGSLFIYNLKSKVVVEWLEGVVRFW

SEQ ID NO: 233154 - protein, 703 aa, Glycine max
  Coding DNA Sequence Number=SeqID_116376
  Gene Ontology: Mol. function=protein serine/threonine kinase activity; Cellular component=cytoplasm; Biological process=protein amino acid phosphorylation
  Homolog annotation: Hit_ID=O81637; Match level="QueryCoverage=74%, HitCoverage=80%, E-value=1e-167, Identity=57%"; Hit description =Mitogen activated protein kinase kinase
  Pfam annotation: Domain name=Pkinase; Domain location=19-254; Score =154.9; E_value=2e-43; Accession=PF00069.15; Description=Protein kinase domain
  Pfam annotation: Domain name=Pkinase_Tyr; Domain location=31-254; Score=-8.3; E_value=5.8e-12; Accession=PF07714.7; Description =Protein tyrosine kinase
  Pfam module annotation: Pfam domain module=Pkinase::Pkinase_Tyr; Domain location=19-254::31-254
MVLHLLWQSAVSMWKSIPREDMEDYRAFDEYEGIENPEDLERLYSEIHLLKTLKHKNIMKFYTSWVDTTNRHINFVTEMFTSGTLRQYRLKHKRVNIRAVKHWCRQILEGLLYLHSHDPPVIHRDLKCDNIFINGNQGEVKIGDLGLAAILRKSNAARCVGTPEFMAPEVYEEDYNELVDIYSFGMCILEMVTFEYPYSECNHPAQIYKKVVSGKKPEALYKVDNTEVRQFVEKCLATVSLRLSARELLDDPFLQIYDYGFDSKVVQYHRDCYEVNPLIRQPLNGIYSINNNLMSGDTDNVGGYGPVSKLDYHRDDFEASEIGLFGCEEDDNLAEVDTTIKGRREDDGIFLRLRIADKEGRIRNIYFPFDIETDTALSVANEMVAELDINDQDVTNLANMIDNEIATLVPEWKTGPIIEEKSECSSASVCLNCAANGYLFDYVLSNNPCGKNLQFLHCSKTGCAAVHGRFEEITYQVEGSKNSAREGALDASSQSNDIQYTDIWAQRDEPELCHEELKDIHCDQAHEASNSSNIKEDGKTINVDEQSDLNTRKPSSNPAPNCVFLDYENEIRQELRWLKAKYQMQLRELRDQQLGGKPKFTSISPDTDKLEHLKDGILRLSDASNLKIQNNKPLLKTIVSGKHFHIESEKCNSLADQMVQNVDEIRRSNSPEQMITVKDFFTGVLLPHSLQRATSLPVDAVDV

SEQ ID NO: 233155 - protein, 109 aa, Glycine max
  Coding DNA Sequence Number=SeqID_116377
  Homolog annotation: Hit_ID=Q8S8L5; Match level="QueryCoverage=60%, HitCoverage=55%, E-value=3e-11, Identity=50%"; Hit description =Expressed protein
  Pfam annotation: Domain name=Auxin_inducible; Domain location=8-103; Score=42.3; E_value=1.1e-09; Accession=PF02519.5; Description=Auxin responsive protein
MMLIRSFVGKIEKGVSHFVHRRPPLNDHFNEATSVLPDDVMEGYFAVLAIKDGESKRFIVGLHYLNDPAFIELLDQAQEEFGFRQQGTLIVPCQPQELQKILDGRSWRA

SEQ ID NO: 233156 - protein, 153 aa, Glycine max
  Coding DNA Sequence Number=SeqID_116378
  Gene Ontology: Mol. function=imidazoleglycerol-phosphate dehydratase activity; Cellular component=cytoplasm; Biological process=amino acid biosynthetic process
  Homolog annotation: Hit_ID=Q43072; Match level="QueryCoverage=96%, HitCoverage=50%, E-value=1e-63, Identity=83%"; Hit description =Imidazoleglycerol-phosphate dehydratase
  Pfam annotation: Domain name=IGPD; Domain location=1-143; Score =258.2; E_value=1.7e-74; Accession=PF00475.9; Description =Imidazoleglycerol-phosphate dehydratase
MGWQLASHGLFDVRIKATGDIHIDDHHTNEDVALAIGTALLHALGDRKGINRFGNFSAPLDEALIHVSLDLSGRPHLSYNLDIPTQRVGTYDTQLVEHFFQSLVNTSGMTLHIQQLMFYIPILKTFNRIYIEATFKAFARAIRQATGYDPRHL

SEQ ID NO: 233157 - protein, 88 aa, Glycine max
  Coding DNA Sequence Number=SeqID_116379
MNIFVTSFFDKPLLPWLSLLLFFLLKDHHQPNHRPPPAPPVAPPPITAHVIVSLHHHFLQLSNLTSLQSLFLTLGPQTNSLSLGIGKG

SEQ ID NO: 233158 - protein, 105 aa, Glycine max
  Coding DNA Sequence Number=SeqID_116380
  Homolog annotation: Hit_ID=Q8S8L5; Match level="QueryCoverage=63%, HitCoverage=55%, E-value=2e-12, Identity=52%"; Hit description =Expressed protein
  Pfam annotation: Domain name=Auxin_inducible; Domain location=9-101; Score=49.8; E_value=8.8e-12; Accession=PF02519.5; Description=Auxin responsive protein
MLRSFVGKIEKGVSHFVHRRPPLNYLSEATTSVVPDDVREGYFAVLAIKGGESKRFVVGLHYLNDPAFMVLLDQAQEEFGFRQKGALAIPCQPQELQKILDGWKA

SEQ ID NO: 233159 - protein, 136 aa, Glycine max
  Coding DNA Sequence Number=SeqID_116381
  Gene Ontology: Mol. function=nucleic acid binding
ITQSQEMSHREFTLEDYSSSSSPQYFTSIVQPEVQATNISYPHFLIQLIQGNLFQGLPNEDPCAHLATYIEICNTVKIDGVLEGVICLNLFFFSLANKSKRWLHSFKGNSLRTWEEVVEKILKKYFPESKTAHGKA

SEQ ID NO: 233160 - protein, 646 aa, Glycine max
  Coding DNA Sequence Number=SeqID_116382
  Homolog annotation: Hit_ID=Q8RYN2; Match level="QueryCoverage=25%, HitCoverage=9%, E-value=7e-29, Identity=49%"; Hit description =Auxilin-like protein
  Pfam annotation: Domain name=TolA; Domain location=277-603; Score= -105.4; E_value=0.0007; Accession=PF06519.2; Description=TolA protein
LKHALEQVDNGKGLKQDFELEMNEKRTKVTFDLGENEACERDQGKEILSEICGGYRKGNRLKDVGDDMGVQKVLKQAPDLLKNCGNEAQRMKEIESPSGQAFDRDAVVYISCEDGLSKQCQRMLKDANKNGKHKGLDKALEQMEGNGEGINMNFAKETNETWKTEMDDSIHEENIRKPEVCQGPIADQEIGKTETDCKVGEKKLEKVCVENPRDNRGKGASEMSQGEAEHSGKVACTATNFNGDEHSFSCEQTCTEKTKTAPQMEFDVQSGERKIGERENTKQHVNVALNPEESRDQMPSSQGDYRRNTVADEPAAVQEVGNIQKPSQRAHVSHSTRSKEKNLNETSASVEKDVERIRRDRELEKDRLRKIEEEMERERERQKDRMAVDSAMLEAEREREREKDRMAVDKATLEARDRTYADARERAERAAFERATAEARQRALAEARERLEKACAEARDKTYADKAAAEARLKAEQTAVERATTEARERAMDKVKVDRAAFESRDRLVRSVSDKFSVSFRYGGRQGSSSSDMLDPHCQNSSSFTHSRYPYSSVYGASSFTERSEREGESAQRCRARLERYRRTAERAAKALEEKNMRDLVAQKEQAERNCDTLQRLAETLDTEVRRWSSGKEGNLRALLSTLQYV

SEQ ID NO: 233161 - protein, 748 aa, Glycine max
  Coding DNA Sequence Number=SeqID_116383
  Gene Ontology: Mol. function=heat shock protein binding; Cellular component=integral to membrane; Biological process=protein folding
  Homolog annotation: Hit_ID=O23230; Match level="QueryCoverage=99%, HitCoverage=50%, E-value=7e-41, Identity=26%"; Hit description =Trichohyalin like protein
MESVAHSRQPPHKKITTGAGGFPAETLYDHVYGGAAKFSGGGHHHSLSPRFEDYGEIFASFHAPRASAIPVLDLPALDAAGEVFFDFRNAACDYSEIFRGFDGLNFWLSYEDLFRGSVSEEDDEEEEEAWSPVETDSFSGDFDHFGINEGMPNGDHLRPFDGSTEFNVSYHKVDGSSNEDMSKGKTHISQLRADPEFTHVFDEIMHFHKTDPSLQVVDDVDLDMEFNASQAKRNHLRQTDSYPGNFDSGEQVLGSDLDLHDGCNRNGSHSSETFVTVSDISLRTLPSQVPPPSRPPPALDAKLGHTSGFCSNNEWVDSEETLGDTSPPFLDVEVDTNSSTAAIKEVMHRPEAKHRSAEEVKERKKGFLESNVNSSYDVKNSEAKMSMNISIFNSLNDEGMQTTCDQRIGKKKVSATDERQKTRKATPETVELLEGERLQNMFEEMHIKESRASQESDRSTGVGMWKEATEFFELVGTVESGTVIQPINHSNTKSLVQDTRTHECGKKERETFNIKEEYRNVKEVVEGYQLEESKKKSKAGNGACEQGKNIRKSKSSNEECRQREHVKNEEMAEIFELEKSEKARMVHLHGKTEKKVPKADQSGSLKDVSEKQCKEHKRVESEESKEIDRQKLSEVQWSTKHMEHEKKLKEDEQKQLSMKRLKQSQKMEENGKFHIEAFALGAAENEQGVKGSLKPEIFERSDETFNLDSYKDNLTCKSENEIVLEAKQIQNKKELKEACKNEVEKSLK

SEQ ID NO: 233162 - protein, 74 aa, Glycine max
  Coding DNA Sequence Number=SeqID_116384
MVAKRIEDFEMLLKGSLSKADWLSEAYLLSEKVSSLSKYKTLENVKSESSTLSAQPAHPVRMLSLLALSASKLA

SEQ ID NO: 233163 - protein, 182 aa, Glycine max
  Coding DNA Sequence Number=SeqID_116385
  Homolog annotation: Hit_ID=Q8S8L5; Match level="QueryCoverage=38%, HitCoverage=58%, E-value=3e-11, Identity=50%"; Hit description =Expressed protein
  Pfam annotation: Domain name=Auxin_inducible; Domain location=14-107; Score=46.4; E_value=9.6e-11; Accession=PF02519.5; Description=Auxin responsive protein
MMLWSFFGKVHDGLAVVFAPIKRSLTPISNDDSAREVPGDVLEGHFVVLANKGEERKRFIVELHYLDDPAFLGLLERAREEYGFRQKGVLVIPCYPQELEKILDHESTVGGDGGKLTDSVQDISECSAISCKITWETAAATATAVAEDVSKLRNNRTFHKGMLFALPYKPQGLQKFREEKEA

SEQ ID NO: 233164 - protein, 87 aa, Glycine max
  Coding DNA Sequence Number=SeqID_116386
  Pfam annotation: Domain name=Auxin_inducible; Domain location=2-83; Score=-7.1; E_value=0.00023; Accession=PF02519.5; Description=Auxin responsive protein
MLRNFVGRIQKGLSLFVARRPDAFSYFSEDRTATAAQDDVREDYLHDPAFLGLLDKAQEEYGFRQKGALALPCRPQELQKILDGPKA

SEQ ID NO: 233165 - protein, 383 aa, Glycine max
  Coding DNA Sequence Number=SeqID_116387
  Gene Ontology: Mol. function=protein dimerization activity; Cellular component=nucleus; Biological process=regulation of transcription, DNA-dependent
  Homolog annotation: Hit_ID=Q6L3Y1; Match level="QueryCoverage=96%, HitCoverage=46%, E-value=1e-103, Identity=50%"; Hit description =Putative hAT family dimerisation domain containing protein, identical
MSLSLWHDYGKQSGGDTFVIEGFTNWNKKERLSSHVGGPNSAHNIAWRKCQDLMNQNQHIEVVISKQSKQVRDLYRRRLTASIDCIRFLLKQGFAFRGHDESTNSANQGNFLELLRFLVEHNESINHVVLENAPENHQLIVPKIQKDIVNAAALETTNAIIIDLGDELFAIIVDEARDISNKEQMAIVLRYVNKKGSIVERFFGMVHVKDTTALSLKMAIDELFCKHGLSISRIRGQGYDGASNMQGEFSGLKSLILKENSYAFYVHCFAYQLQLTLVVVAKNHIQVASLFNFVSTLLNVVGGSCKRHDMLREKQINYVREALGKGEIPSGQGLNQETSLKRAIDTRWGSHYATLINLILMYSSIIDVLEIIKEDGSNADQRA

SEQ ID NO: 233166 - protein, 107 aa, Glycine max
  Coding DNA Sequence Number=SeqID_116388
MEHGGWKSSLLQWSMMTGTLRCGDSDKCLGTRVGTKCVVLANKGPIMEDGVEEDEDNEDEEYDDDDYESEYMKKKKQAANGTVNKHDKAVESSCFDTMINLMFVMNE

SEQ ID NO: 233167 - protein, 86 aa, Glycine max
  Coding DNA Sequence Number=SeqID_116389
MMSLEKIGLIALSHGWEHEDTRCTRSQQEWRVCWGSGGNFDSGGDVGVDLELLHGEGGIGEVRGDWMKGCGIYGSLSEGGDDVELG

SEQ ID NO: 233168 - protein, 207 aa, Glycine max
  Coding DNA Sequence Number=SeqID_116390
  Homolog annotation: Hit_ID=Q1ST43; Match level="QueryCoverage=45%, HitCoverage=10%, E-value=1e-16, Identity=42%"; Hit description =Integrase, catalytic region; Peptidase aspartic, catalytic
MTLALYSNQRPIGSLVGYRKSPLRVLLCGVDHFGKIVLEAFPRQINGISGSWDIARPRVVVSANQSWGDGNRGWVVTRMNIIRARWVKTRIIGWRDNIRIACVGSFEMLRSLFGRIQKGLSVFVPRRLSFNYFSEDHVATAAPDDVMEGYFAVLAIKGEETKRFIVGLDYLNDPAFLGLWTKLKKSMVPNNKELLHSLVSLKSYRRF

SEQ ID NO: 233169 - protein, 74 aa, Glycine max
  Coding DNA Sequence Number=SeqID_116391
MEPLTLKKMTHQEDKTKGPLERGRNSVGANMKMKEEEAVSGLIQRRKKKKRCQAKRKKKRCREEDERRSVAGEK

SEQ ID NO: 233170 - protein, 322 aa, Glycine max
  Coding DNA Sequence Number=SeqID_116392
  Gene Ontology: Mol. function=DNA binding; Cellular component=beta -galactosidase complex; Biological process=DNA integration
  Homolog annotation: Hit_ID=Q2HRM8; Match level="QueryCoverage=99%, HitCoverage=30%, E-value=6e-95, Identity=50%"; Hit description =Polynucleotidyl transferase, Ribonuclease H fold
MKFEIQALVRNQTWDIVQTPLHVRPIGCKWVYKIKRGSDGQDENNSGFSGHSFHFSLALAQLDVSNAFLYGDLNEEVYMTIPQGVSGYQPSQCCKLKRSLYGLKQASHQWFAKLSSLLQHYGFTKAHADHNLFTKVTCHTITVLLIYVDDIVLVGNSIAEIDKAKHLLSSNFHISDLGKLKYFLGIEVAHSSSGISLCQRRRLVGHLIYLTSTRPNIVFATQQLSQFMIAPTHFQAALRVVRYLKATPGKGLFFRRNNSFQLSDFSDADWATCVDTHRSVTGYCFFIDNNLVSWKTKKQSTVSRSSVEAEYRALASVTCELQ

SEQ ID NO: 233171 - protein, 41 aa, Glycine max
  Coding DNA Sequence Number=SeqID_116393
MAYAEDMVVCFEDQETGRCLKEIPTKIFQDTIVVEVDDQLY

SEQ ID NO: 233172 - protein, 64 aa, Glycine max
  Coding DNA Sequence Number=SeqID_116394
MGVQKNAPGNRSDVGWKVLSQLMGIPKKLNANNVDGNYWWCLLIEASFGQNTKMLGLANLLEIK

SEQ ID NO: 233173 - protein, 94 aa, Glycine max
  Coding DNA Sequence Number=SeqID_116395
MHPHITEIHKEVIHASGHVRGDILLSQHKKAHQPAATGTPKTQCSYNILVWMTPGSTSSPWYNCGLSSVSYSSHMSGRPSRHYGKHDHKFSATL

SEQ ID NO: 233174 - protein, 555 aa, Glycine max
  Coding DNA Sequence Number=SeqID_116396
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=87%, HitCoverage=42%, E-value=0.0, Identity=63%"; Hit description =Phospholipid-transporting ATPase 1
MDLVRATEAHLHSYSSMGLRTLVIGMRDLNASEFEQWHASFEAASTAVFGRAAMLRKVSSIVENSLTILGASAIEDKLQQGVPESIESLRIAGIKVWVLTGDKQETAISIGYSSKLLTSNMTQIIINSKNRESCRKSLQDALVMSTSGVANNAGVSSHVTPVALIMDGTSLVHILDSELEEQLFQLASRCSVVLCCRVAPLQKAGIIALVKNRTSDMTLAIGDGANDVSMIQMADVGVGISGQEGRQAVMASDFAMGQFRFLVPLLLIHGHWNYQRLGYMILYNFYRNAVLVLVLFWYVLFTAFTLTTAINEWSSTLYSIIYSSLPTIIVGILDKDLGKRTLLKYPQLYGAGQRHEAYNKKLFLLTMLDTLWQSMVIFWAPLFAYWSSTIDVASIGDLWTLGVVILVNLHLAMDVIRWYWVTHVVIWGSIVATFISVMIIDSIPNLPGYWAFFDAAGTGLFWLLLLGIIVTALLPHLVICREAEKIGYDRVVESGQYICLLPDFIGCYPKDRGFVITAEQVLKGSNDSSVWRKSECERGNSSLSTFRSPEGDWSR

SEQ ID NO: 233175 - protein, 63 aa, Glycine max
  Coding DNA Sequence Number=SeqID_116397
MAVVIPERTFQSPFPRWYNPNTTCAYHGGVPGPGFNRHRLADVPRGNPKRKDKPSYQSWGANG

SEQ ID NO: 233176 - protein, 176 aa, Glycine max
  Coding DNA Sequence Number=SeqID_116398
MASMMEAMLSMKRLIERGTREEPRERAQGDFDSYPLFTAEGLAFKVMPQPNTAGASQPCPLQPLHFSVGGPPSIVEGREKLDLIEERLKAVKGFGYYPFVDMTYLCLVPDVVIPPKFKVPDFDRYKGTTCPKNHLKMYCRKMGAYSRDERLLMHFFKDNLVGAAVIWYTNLEASRV

SEQ ID NO: 233177 - protein, 658 aa, Glycine max
  Coding DNA Sequence Number=SeqID_116399
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=85%, HitCoverage=47%, E-value=0.0, Identity=65%"; Hit description =Phospholipid-transporting ATPase 1
  Pfam annotation: Domain name=E1-E2_ATPase; Domain location=187-469; Score=-121.5; E_value=0.017; Accession=PF00122.10; Description=E1-E2 ATPase
  Subcellular localization annotation: CTP_CleavageSite=60; ConfidenceScore=5.63e-01
MGSNRPILMTVPSPTTSSSNNQQQQDHPLTSIDPELPKSNSSSINPFENTFNNSSSRRSSAGSRSSNNSIHEVISLSRSESKTKPLKYYGSSKGGGGADSEGLSMSQRELRDEDARLVYINDPLKTNEAFEFSGNSIRTSKYSLLTFIPRNLFEQFHRVAYVYFLIIAILNQLPQLAVFGRTVSILPLAFVLFVTAVKDVYEDWRRHQSDKIENNRLASVIMVDDDGGGGGGGGRRRSFVEKKWRDVRVGEVIKIEANETIPCDIVLLSTSDPTGVAYVQTINLDGESNLKTRYAKQETHGKEMFGGVIKCEKPNRNIYGFLANMEVDGKKLSLGSSNIVLRGCELKNTSWAIGVAVYCGSETKAMLNNSGAPSKRSRLETRMNSEIIWLSFFLVMLCTVTSACAAVWLKRHKEELNLLPYYRKLDFSEGDVDSYEYYGWGLEIFFTFLMSVIVFQVMIPISLYISMELVRVGQAYFMIQDKRMYDEATKSRFQCRALNINEDLGQIKYVFSDKTGTLTQNKMEFQCASIWGVDYSSKENNSIMEGDELVEHYVEADGKIFRPKMKVKVNPELLQLSRSGLQNVEGKWIHDFFLTLATCNTIVPLVVDTPDPDVKLIDYQGESPDEQALAYAAAAYGFMLIERTSGHLVIDIHGQRQK

SEQ ID NO: 233178 - protein, 82 aa, Glycine max
  Coding DNA Sequence Number=SeqID_116400
MVEREMIIMIVDTLSVFYYKKLMGYMPSSFVDLVFIGERIEVGLKKGKFDYVGPAGTNNKIFGASGAKRKEGEAQAVTVAPA

SEQ ID NO: 233179 - protein, 427 aa, Glycine max
  Coding DNA Sequence Number=SeqID_116401
  Gene Ontology: Mol. function=phosphoric monoester hydrolase activity; Cellular component=chromosome, pericentric region
  Homolog annotation: Hit_ID=Q84K83; Match level="QueryCoverage=54%, HitCoverage=47%, E-value=3e-47, Identity=45%"; Hit description =Putative NLI interacting factor
  Pfam annotation: Domain name=NIF; Domain location=224-421; Score =182.1; E_value=1.3e-51; Accession=PF03031.8; Description=NLI interacting factor-like phosphatase
MGQTDISFNGCTDSMGQTEISFSGCTDSVVARDSLSSFLSSDSEAISPYNGPNYDQCQQFETVISEQFTWEPQLDVDDNFFSSFQMCDLDSSAYETGFPIIDELSSFDNSQSCYNLSDLLFPGINFTNDGTEENMEYPTLEETIGAADFTFGGSSEGFQQMFDSSWVNHLMCHQAIAFTEELTVSSSEISSDRVDYWDQETFIKGVLDLADDANSLPALLIDETSKRKKVTLALDLDGNFLSSMLTRMDTDLFNGKLFWDYIMNNVLHYQKNQCDGADFTFKMITDRERTVYVRKRPFLQEFLAKVSEMFEIIIFTASKRMYAETLLDVLDPDKKFFSRRVCRESCTWKDRCCVKDLTVLGIDLAKVCIIDNTPEVFRFQVNNGIPIKSWYDDPTDSALMSLLPFLEKLVDVEDVRPLIAEKFGART

SEQ ID NO: 233180 - protein, 234 aa, Glycine max
  Coding DNA Sequence Number=SeqID_116402
  Homolog annotation: Hit_ID=Q84QI2; Match level="QueryCoverage=42%, HitCoverage=31%, E-value=3e-11, Identity=38%"; Hit description=REX1-B
MVASERAMEEEDFDFEKKVSIKESMSMSMSTELDPAKVLLLLRGFLQIQQRRAEAYSKLKSGFSDYMASGGELAYKQLCSEITIEFNNCSKKVLEMESLFRSPDYCRVDLAQLLRAVQDQEKQKLQLKTPLQAYFSVATRNMLLHTATIQVLKKAGRPSERLVSHENCKFTKPAEHECVHVQEITEASGTEEAEADAEYDNALKEAIRGVQDAVMAINEHLEEVRYEIAALEAE

SEQ ID NO: 233181 - protein, 407 aa, Glycine max
  Coding DNA Sequence Number=SeqID_116403
  Homolog annotation: Hit_ID=Q2R8W9; Match level="QueryCoverage=34%, HitCoverage=30%, E-value=2e-31, Identity=46%"; Hit description =Pentatricopeptide, putative
MISCYGAHGKGEESLLLFKKMVDEGFRSNPVTLPAILTSCSRSGLIDQGKHIFSSICSDYGFEPTVEHYARMVDLLSRCVYLLEALQFLENMKASGTGSMWGALLAGCVMDKNVEVGEMAAHQLFQLEPDNASNYIALCALKPLHLIMARRAQQKNKGWPWSCTLTARHQDRHSRIEPLPTITRNCEAHVAYCTKDPKGVRRGETSQGMNADVGAGVCNEEEDVALTPMRGAPLLITVIAEPFIVAGCHLFREGWGGGGGEGWGYGRKGWRRSLILSSCKRAKATACGKDNGDEAVLVHPLKPTKGWAIKIKGSDGDTVVVGGSLVVKKLGDLEDPTQGVVPIKARDVQLDGVTSASRIKKKWLLLIDQWWCVGWYGPPLETGGRSDQCYEQEGDASLVSRTKASSQ

SEQ ID NO: 233182 - protein, 93 aa, Glycine max
  Coding DNA Sequence Number=SeqID_116404
MAMGRGGYGYCFPNLRLRLSNISDIRRVKVYYLIPVPVGEMLSLNGMMRVDFMTLPSILKACGKEGDLLKAREVHGNVARSFDFDAAAAIGMR

SEQ ID NO: 233183 - protein, 792 aa, Glycine max
  Coding DNA Sequence Number=SeqID_116405
  Gene Ontology: Mol. function=nucleic acid binding; Cellular component= intracellular; Biological process=chromatin modification
  Homolog annotation: Hit_ID=Q9ZVD0; Match level="QueryCoverage=75%, HitCoverage=80%, E-value=1e-166, Identity=53%"; Hit description =Expressed protein
  Pfam annotation: Domain name=ARS2; Domain location=496-743; Score= -83.0; E_value=0.02; Accession=PF04959.3; Description=Arsenite -resistance protein 2
MAEVINNMPPESLDQSPSSSAPPPPPPPPPASSSGPADDLPPPPLPPPPRRRDRRDDRDFDRHPNRSRDYYDRDRDFKRRRSPSPGYRDRRYSPPPPSRRSPPPYKRSRRGSPRGGGYGPDDRCDSSFCPGFDDLLCTIEVYGVEFVFVVELVVGCFGYVAEKVMGSELSDFLWGLQVPLAEHWILGLDWIFGYDYSGGYERGAGGRTGYADEKSYGRLVHRSAGGYHNGISDVDNSRGYADLSSGGAQRISVNGMVFEKGNMAKEPIYSYNIAGLNHEGLMSYKQFIQELEDDVLPAEAERRYQEYKSEYISTQKRAYFNAHKDEEWNENARRLAKDFLLDLQSGTLDLNPGLNSTSSGKSGQASEPNSEEETDGKRRRHVRGPNKDNDFSAAPKAHPISSEPRRIQADIQQAQAVVRKLDREKGIEDNILCTSDHNKNDDKAHSGSVGPIVIIRGLTSVKGLEGVELLDTLITYLWRIHGVDYYGMVETNEAKGFRHVRPEGAGHEETSKSGSDWEKKLDSFWHGRLNGQDPLEVMTAKEKIDAAATDVLDPHVRKIRDEKYGWKYGCGAKGCTKLFHAAEFVHKHLKLKHPEIVMELTSKMREDLYFQNYMNDPDAPGGMPVMQQPQDRPLKRRLGGLEGRLKDDRGNRRDQDRSDRMNGDRPDGSPSHERQMGNHDEAMYDAYGGPGVPAFTSDMPPPPVLMPVPGAGPLGPFVPAPPEVAMQMFREQGGPTSFDASGRKMRSGPHMGGPAPIIAVPPSFRPDPRRMRSYEDLDAPEDEVTVIDYRSL

SEQ ID NO: 233184 - protein, 66 aa, Glycine max
  Coding DNA Sequence Number=SeqID_116406
MRGLESHAWLLRVLDNSLVQVGNLGFSNTLYLSNVECEIIGKLQLYNRMNRIWKKISHHKRDIVSA

SEQ ID NO: 233185 - protein, 951 aa, Glycine max
  Coding DNA Sequence Number=SeqID_116407
  Gene Ontology: Mol. function=nucleic acid binding; Cellular component= cytoplasm; Biological process=DNA integration
  Homolog annotation: Hit_ID=Q2LFC1; Match level="QueryCoverage=99%, HitCoverage=95%, E-value=0.0, Identity=64%"; Hit description=AGO4-2
  Pfam annotation: Domain name=DUF1785; Domain location=193-245; Score =93.1; E_value=8.3e-25; Accession=PF08699.1; Description=Domain of unknown function (DUF1785)
  Pfam annotation: Domain name=PAZ; Domain location=246-382; Score =125.7; E_value=1.3e-34; Accession=PF02170.12; Description=PAZ domain
  Pfam annotation: Domain name=Piwi; Domain location=531-912; Score =404.7; E_value=1.3e-118; Accession=PF02171.8; Description=Piwi domain
  Pfam module annotation: Pfam domain module=DUF1785::PAZ::Piwi; Domain location=193-245::246-382::531-912
MEVSKRVPMARKEVGSKGEPRQLLANHFGVCLVKPKDDIDGYFYHYDVAMSYEDGNPVEAKGVGRKVLNQVCETYVELRNMSFAYDGEKSLFTLGPLASQRLQYPVVLEDVSSRRVGKNGNPAESPKGGYTKRMRIRHQFRPKTINVDIKYAAKIPLQAIEDALRGRDSEKSQEAVRVLDIILRQHSANQGYLLVRQSFFHDNRRTCTDIGGGVQGCRGFHSSFRVTQGGLSLNMDVTTTMIVKPGPVVDFLLQNQSVQNPNYIDWTKAKRMLKNLRIRANGVEFKISGLSDNTCRNQKFLLRQKGTNGEVQEREITVHDYFTRQKLIGLNYSADMPCINVGKPKRPSYFPIELCEMVSLQRYTKALTNLQRAQLVEKTRQKPQVRRQALEDALRSSRYDDEPMLRSSGITIEPNFVRLVGRVLEPPKLIVGGEKSIIPRNGRWNFNNKKLYEPLMIGRWAIVNFSSRCDTRLLIELIRRCAAAKGMTMSNSLFDKVIEEDGCFIREPPNVRVERMYAKLRTTLPHEKPHFLLCILPEKKNSDIYGPWKKKSLVEEGIVTQCIAPTKINDQYITNVLLKINAKYGGMNSYLSVELCNSIPFVSAVPTLILGMDVSHGSPGRSDVPSIAAVVSSRCWPQISRYRASVRTQSSKVEMIQSLFKPVANTNKDEGIIREVLLDFEITSFKRKPQQIIIFRDGVSESQFNQVLNIELSQIIEACKHLDEKWDPKFTLIIAQKNHHTRFFQANARDQTNVPPGTVIDNTVCHPKNNDFYLCAQAGMILCHFGQPLSPFGHGGIHRRDPPGTPLRHRRGPGPLRRHLGGREPGVPWFPLLSPLTSNIEMCISHIGWWWGTTRPTHYHVLHDEIGFSADEVQELVHSLSYTYQRSTTAVSLVAPICYAHLAAAQMAQFMKFDEHSETSSTHGGLTSASAPLVPQLPRLHKQVINSMFFC

SEQ ID NO: 233186 - protein, 232 aa, Glycine max
  Coding DNA Sequence Number=SeqID_116408
MRAPHMLVATDRRNVCLQCILQRSEKGRVLKSDDLPYLSCQKHVHHGQLDKSNPDNTCPGSGLLKPHRLVILLYSLRLPYLTPDNMTLTSLQVKSRSRVYETLTSLRKLSSLITLSDNTCPYLGAQQTCHPMLVKTTTPDIRQTPQHGTISFNTGQPFSPASWLSAWGAYDMTKSKRKDSLEGLGGPMTRARERKANEALQQVLPILFEYKPKFQGEKSKVVSCIMAQMEED

SEQ ID NO: 233187 - protein, 842 aa, Glycine max
  Coding DNA Sequence Number=SeqID_116409
  Gene Ontology: Mol. function=zinc ion binding; Cellular component =nucleus; Biological process=transcription
  Homolog annotation: Hit_ID=Q9LIE5; Match level="QueryCoverage=99%, HitCoverage=100%, E-value=0.0, Identity=62%"; Hit description=Far -red impaired response protein; Mutator-like transposase-like protein; phytochrome A signaling protein-like
  Pfam annotation: Domain name=FAR1; Domain location=89-290; Score =254.9; E_value=1.6e-73; Accession=PF03101.5; Description=FAR1 family
  Pfam annotation: Domain name=SWIM; Domain location=568-604; Score =30.8; E_value=4.7e-06; Accession=PF04434.8; Description=SWIM zinc finger
  Pfam annotation: Domain name=WRKY; Domain location=149-189; Score= -13.7; E_value=0.034; Accession=PF03106.6; Description=WRKY DNA -binding domain
  Pfam module annotation: Pfam domain module=FAR1::SWIM::WRKY; Domain location=89-290::568-604::149-189
MDIDLRLPSGEHDKEDEETTTIDNMLDSEEKLHNGGIDGRNIVDAGIEVHALNGGDLNSPTVDIVMFKEDTNLEPLSGMEFESHGEAYSFYQEYARSMGFNTAIQNSRRSKTSREFIDAKFACSRYGTKREYDKSFNRPRARQNKQDSENSTGRRSCSKTDCKASMHVKRRSDGKWVIHSFVKEHNHELLPAQAVSEQTRRMYAAMARQFAEYKTVVGLKNEKNPFDKGRNLGLESGEAKLMLDFFIQMQNMNSNFFYAVDLGEDQRLKNLLWIDAKSRHDYINFCDVVSFDTTYVRNKYKMPLAFFVGVNQHYQFTLLGCALISDESAATFSWLFWTWLKGVGGQVPKVIITDHDKTLKSVISDMFPNSSHCVCLWHILGKVSENLSPVIKKHENFMAKFEKCIYRSLTSDDFEKRWWKIVDKFELREDECMQSLYEDRKLWAPTFMKDVFLGGMSTIQRSESVNSFFDKYVHKKTSVQDFVKQYEAILQDRYEEEAKADSDTWNKVATLKTPSPLEKSVAGIFTHAVFKKIQAEVIGAVACHPKADRHDDTTIVHRVHDMETNKDFFVVVNQVKSELSCICRLFEYRGYLCRHALIVLQYSGQSVFPSQYILKRWTKDAKVRNIIGEESEHVLTRVQRYNDLCQRALKLIEEGSLSQESYGIAFHALHEAHKSCVSVNNSSKSPTEAGTSGAHGQLSTEDDTQSRNMSKSNKKKNPTKKKKVNSEAEVITVGALDNLQQMDKFSTRAVTLEGYYGTQQSVQGMLNLMGPTRDDYYGNQQTLQGLGPISSIPTSHDGYYGTHQGMPGLAQLDFLRTGFTYGIRDDTNVRATQLHEDPSRHA

SEQ ID NO: 233188 - protein, 316 aa, Glycine max
  Coding DNA Sequence Number=SeqID_116410
  Gene Ontology: Mol. function=protein dimerization activity; Cellular component=nucleus; Biological process=regulation of transcription, DNA-dependent
  Homolog annotation: Hit_ID=Q32WR6; Match level="QueryCoverage=99%, HitCoverage=98%, E-value=1e-110, Identity=67%"; Hit description=BZIP transcription factor
  Pfam annotation: Domain name=bZIP_1; Domain location=241-301; Score =48.1; E_value=2.9e-11; Accession=PF00170.11; Description=bZIP transcription factor
  Pfam annotation: Domain name=bZIP_2; Domain location=242-296; Score =45.8; E_value=1.5e-10; Accession=PF07716.5; Description=Basic region leucine zipper
  Pfam module annotation: Pfam domain module=bZIP_1::bZIP_2; Domain location=241-301::242-296
MGSQCGGDNSGKHSQLQPLVPQNSMYSLTLDEVQNHLGDLGKPLSSMNLDELLKNVWTVEANQSTGVDIEGTALTSQAALQRQASLSLTSALSGKTVDEVWRDIQQSKDNKDKKSQERQSTLGEMTLEDFLVKAGIVAEASNRKNTGATVGVDSNVVAPQFPQHGPWIQYAQPQYQHPQQGLMGIYIPGQNKAQPLHMGAGVATDVLYADGQVALSSPVMGTLSDTRRPGRKRGTSEDMVEKTVERRQKRMIKNRESAARSRARKQAYTTELEHKVSRLEEENEKLRRQQELEKMLSSNPPPEPRYQIRRTSSASF

SEQ ID NO: 233189 - protein, 112 aa, Glycine max
  Coding DNA Sequence Number=SeqID_116411
MVLLLHTLSQDSLLKIDDSMTSRLDCPSTQETLMQHIMKNEWRRLDHNYQRKSPIIIFKEKQNLLRILFFLFRTESGTVYLWIILNPFVSPTAEDAKPRRLGALPKYGFSYI

SEQ ID NO: 233190 - protein, 281 aa, Glycine max
  Coding DNA Sequence Number=SeqID_116412
  Gene Ontology: Mol. function=protein binding; Cellular component =integral to membrane
  Homolog annotation: Hit_ID=Q3BYI3; Match level="QueryCoverage=73%, HitCoverage=66%, E-value=3e-72, Identity=71%"; Hit description =Putative membrane protein
MAVAHQQAQDLAAPVHAFDQRGIAIGGGRIAQAELPCGKDGRAGRWPAMHAVNPTASAAAPVSVRIRSFPLWTSHGRCQPVRPARRYRHPPRRCLGPDQGRGEENRRCAGRRPGAERAAGDRGQRQPRAAGGVGGGQGLAGQQGDPGTGSTGDQRPGGLAAQPRLERAADRAADDDRWCLPLFRRRGEAGAPLPALSRGRRRASGRTAQGAGRYAGGHGGVGEGQGEGRDPHRLHPLGRDHRADPGRGGHRVVHQPGGHAGRGCIGDDGVRLWAGRGHREA

SEQ ID NO: 233191 - protein, 162 aa, Glycine max
  Coding DNA Sequence Number=SeqID_116413
  Subcellular localization annotation: CTP_CleavageSite=20; ConfidenceScore=5.32e-01
RARARPAKAPSTSAAPPPARTSATPSTSPSAYFHRLEAMLWSIHQGQIILLQSLQLVAPPDSIPSVEQFNEWVAWPGTQPPLHREDEGPIAQVPQEMEDGSSETSTPEPLIKRKRVVETQEVATTSKKSLEATSEPSEPVADTASIQQLADPSTPEDQTTAV

SEQ ID NO: 233192 - protein, 56 aa, Glycine max
  Coding DNA Sequence Number=SeqID_116414
MSVHPQRMNSLNAAWLSARIRPLSEVYRFEKLQLSLSQALAGLAKMMHLKYRGACA

SEQ ID NO: 233193 - protein, 154 aa, Glycine max
  Coding DNA Sequence Number=SeqID_116415
  Gene Ontology: Mol. function=pectinesterase activity; Cellular component=cell wall; Biological process=cell wall modification
HHLVDCRDLNQLNVYYLASISEELKSASSSDSELIEKIESYLSAVATNHYTCYDGLVVTKSNIANALAVPLKDVTQLYSVSLGLVTEALDKNLRRNKTRKHGLPTKTFKVRQPLEKLIKVSITDLLLFAWETDISSMGFSSIQSSEPSAENMIH

SEQ ID NO: 233194 - protein, 144 aa, Glycine max
  Coding DNA Sequence Number=SeqID_116416
  Gene Ontology: Mol. function=actin binding; Biological process =cytoskeleton organization and biogenesis
  Homolog annotation: Hit_ID=Q1T1I1; Match level="QueryCoverage=60%, HitCoverage=9%, E-value=3e-23, Identity=67%"; Hit description=Villin headpiece; Gelsolin region
MSMGGTDVKPCLSTSKFNKKVLETNWLTYLVKIWGLEHFSVFSIYLTSLEVSMSKKHQQSIKIVELDAALRGRVIQYREVQGHETEKFLSYFKPCIIPQQGGAASGFKHDEAEEHKTTVVCVQRETYGACQIGKFDLIPLPLTH

SEQ ID NO: 233195 - protein, 93 aa, Glycine max
  Coding DNA Sequence Number=SeqID_116417
MAISISSNYYMIRGWSFRVDVEEEPNFISQKPQNAKKKVMSMVASRWRQFKSTLTTKFVYADTEGQDKEDPSRKYGMDQQTWEEFVASRKTAN

SEQ ID NO: 233196 - protein, 211 aa, Glycine max
  Coding DNA Sequence Number=SeqID_116418
MLIENTPFIEDPPSPIERHMKWKLGHTKRYVQMTSQATQEIFDRIDYLQEQTMQGTFVPHGHDDILSTAIGRPEHPGRFRAAGSGMTISHYYGRASCGSSSSFTSITQQQLVEIILSLKEEWRSARLSTKGSNPETAINPSGEERVGHMLPTMGLYVQHDHCAHLVALGKAYEGGINGSGMEKDKDDWRSHFKEKISQEEAHHHRKPWIRA

SEQ ID NO: 233197 - protein, 562 aa, Glycine max
  Coding DNA Sequence Number=SeqID_116419
  Homolog annotation: Hit_ID=Q8W3M0; Match level="QueryCoverage=27%, HitCoverage=24%, E-value=1e-52, Identity=61%"; Hit description =Ethylene-insensitive-3-like protein
  Pfam annotation: Domain name=EIN3; Domain location=1-340; Score =119.6; E_value=8.7e-33; Accession=PF04873.4; Description=Ethylene insensitive 3
YDEETGFDDLRNEFSGDPSSAYRLSDLPDTTLGSLLSCLMQHCDPPQRRYPLDKNVPPPWWPTGLEIWWPELGFAVDPGPPPYRKPHDLKKVWKQCVLTAVIKHISPDITKIKNMVRLSRTLQDKLTAKETAIWSAVVKREETLARRLHPHLFPAKPIIRRPHHAIRGYDIEGSGARARNFLGGQSSHNPPPTSNVAAHSNNSMLLASGTARSFLGGQSSHNPQPTSNVGNGGARNFFGGQNYPPLTSNVDSGDGRSFLGGQNNPPPITSNVANGINNNNSMVTMNNGIVLPPDHGANKRKEVQGITIPHDTYSCHSSQCPYHETSFGFSDMNVRNNHQLACIYNNGNNNNNNIVQVVGGGGGGSSSSQLGPGNPKNNVNVALGQSMHIAAPVVNQTQTQNLTIGQPRHSAAPAVNNQNQTLNVISDNNNSGEIGSNGSMHNMNVVVPLGNQNQQQVQNVLQPQVVDSNNFYGGGRVSLDKNNNNLFGNNSMNINSVPPLLVCQNMQQVQSVQPQVMDKNFFVGGRVSLDKNNNNLFDNNMNTFPLLGSQNMQQVQNVHEPQ

SEQ ID NO: 233198 - protein, 53 aa, Glycine max
  Coding DNA Sequence Number=SeqID_116420
  Gene Ontology: Mol. function=sequence-specific DNA binding; Cellular component=nucleus; Biological process=regulation of transcription, DNA-dependent
  Homolog annotation: Hit_ID=Q8H0Y8-2; Match level="QueryCoverage=96%, HitCoverage=18%, E-value=3e-16, Identity=65%"; Hit description =Isoform 2 of Q8H0Y8
  Pfam annotation: Domain name=WRKY; Domain location=20-52; Score=8.7; E_value=6.2e-05; Accession=PF03106.6; Description=WRKY DNA -binding domain
MPKWAEQIRVKIDNGIEGPLEDCYSWRKYGKKDILSAKYPRSYCRCTFRNTKG

SEQ ID NO: 233199 - protein, 266 aa, Glycine max
  Coding DNA Sequence Number=SeqID_116421
  Gene Ontology: Mol. function=RNA-directed DNA polymerase activity; Cellular component=chromatin; Biological process=RNA-dependent DNA replication
MRNDSTKEAEIAKTKKSNRIAEIGVQAVSGGTGPRSQYSLSDPLSVSIFGALVVLMPDFEKNPGPSDRLEDALLRLTTQNMYLGESVHALTLQLKELLQRTNTTPQSSPIPISPSPTSPTPASQHRMKLDIPRFDGSEPQGWIFKINQFFEYHSTPEQDKLTVASFYMEGRALAWYQWMNANGHFTSWSSFIQALRARFAPTPYDDPTGALFKLTQKGTVAQYLTEFEDLATRVVGISPPLLLSCFISGLSPEIRREVQAHQPLSM

SEQ ID NO: 233200 - protein, 161 aa, Glycine max
  Coding DNA Sequence Number=SeqID_116422
  Homolog annotation: Hit_ID=Q9SYP2; Match level="QueryCoverage=40%, HitCoverage=10%, E-value=2e-07, Identity=51%"; Hit description =Pyrophosphate-dependent phosphofructokinase alpha subunit
MVFFPLKNHVVAYSFEGLVPDHIKRLIAKVKSMDWERKYEKVLWRQETEDQAIVLKGGAVDASMAAVMNKLSYFYSYMAGSSKVGYIFRDPKFSAVHIPQAIRFWKIDFEEIHGLLRQGATIDKISSKLSPLVFTLLEFPPPIGNKLLFYPESDDLIMKHN

SEQ ID NO: 233201 - protein, 105 aa, Glycine max
  Coding DNA Sequence Number=SeqID_116423
MENGRGKKSSKVVKSIARLNHTSSNRRIGRRTRDGVKSAHVLDLIIRDHTFKALNKNFKTAIPQSVDLPSNLSGIGVDAVTFRCGRLRRYGAHLKEFHVLRRYAD

SEQ ID NO: 233202 - protein, 94 aa, Glycine max
  Coding DNA Sequence Number=SeqID_116424
MKVIFSYLVIVEIVVEVAATMKEIVDDIRGDRDGEVVVIVEGDKVNEGGEEQVDYIFVGEIEHELELGTDLHESVIGVLRTFHKKLTPLIRVTI

SEQ ID NO: 233203 - protein, 1239 aa, Glycine max
  Coding DNA Sequence Number=SeqID_116425
  Gene Ontology: Mol. function=RNA-directed DNA polymerase activity; Cellular component=chromatin; Biological process=chromatin assembly or disassembly
  Pfam annotation: Domain name=Chromo; Domain location=1139-1187; Score= 29.8; E_value=9.6e-06; Accession=PF00385.14; Description='chromo' (CHRromatin Organisation MOdifier
  Pfam annotation: Domain name=RVP_2; Domain location=69-203; Score= -37.2; E_value=0.00079; Accession=PF08284.2; Description=Retroviral aspartyl protease
  Pfam annotation: Domain name=RnaseH; Domain location=577-694; Score= -22.7; E_value=0.0075; Accession=PF00075.14; Description=RNase H
  Pfam annotation: Domain name=rve; Domain location=833-989; Score =106.5; E_value=8e-29; Accession=PF00665.16; Description=Integrase core domain
  Pfam annotation: Domain name=zf-H2C2; Domain location=774-815; Score =25.0; E_value=0.00017; Accession=PF09337.1; Description=His(2) -Cys(2) zinc finger
  Pfam module annotation: Pfam domain module=Chromo::RVP_2::RVT _1::RnaseH::rve::zf-H2C2; Domain location=1139-1187::69-203::316 -485::577-694::833-989::774-815
MALRREKGLCLRCDEKYHRGHKCSSRFFILISDDLEPITSHIPIPDPTHHPPPDPPDNLDLYPAQISLNSLAGHIAPETLRFVGQLSGQPMLILVDGGSTHNFIQLQMVTELGLLCHETRPLQVLVGNGQHLTCNYVCEAIPVEIQGLTFPIDLYVLPISGANIVLGVQWLRTLGPVLTDYTKLCMQFFFQDQLVTLQGNTEDTLGMLSSSQFRRLLRRQSPGLYFHITVAPSDTNPVSTADFPEDIRSLLTKFDPLFNPLQDMPPARETDHHIHLLPQATPVNVKPYRYPHFQKQEIEAQVASMLQKGLIQPSTSPFSSPVLLVKKHDGSWRFCVDYRALNAITIKDRFPIPTIDELLDELGNAQCFSKLDLLQGYHQIRMHSGDIPKTAFRTHHGHFEFKVMPFGLCNAPSSFQATMNLIFRPYLRHFVIVFFDDILIYSPSFSDHLKHLELTFQVLLDNNFLLKLSKCSFAQSQVEYLGHLVSSRGVEPLASKVAAVVQWPIPQSPRALRSFLGLAGFYRRFIKGYAMIADPLVKATTREPFQWSSQAQMAFDQLKHALSTAPVLALPDFHLPFTVETDASGIGMGAVLSQQGHPIAYFSKPFTAKLLRSSTYVRELFAITAAVKKWRQYLLGHPFTIVTDHRSLKELLTQVIQTPEQHTYLARLLGYNYTIQYRSGSHNQAADALSRLPEHMPHTATMSLLLSVPCLTFLDELHKQLHQNPQYIQQFQEVANSSESHPDFTIAQDLLLYKGRIWLPRNIPLIHSLLTEYHATPTGGHMGVAKTIARLSENFQWQGLRQDVAEFVARCMECQQTKYETKRVAGLLCPLPVPARPWEDLSLDFITGLPPCQGKTVILVVVDRFSKGIHLGSLPTAHTAHMVASLFVDIVVKLHGIPRSLVSDRDPLFVSHFWQNLFHLSGTKLRMSSAYHPQSDGQTEVMNRIIEQYLRSFVHHRPGTWGKLLPWVEWSHNTSWNVGTGSTPYEVTFGRKPFNFPDYLAGSSQIAAVDDMLTNRDEVFQSIRKKLLKAQESMKRQADAKRRELSFQIGDWVLLKLRPYRQRSARGTQSTSGKLAKRYYGPFQIIDKVGAVAYRLKLPEGTRIHSVFHCSLLKSFHGEPDAVRIADLPEQFLNDHPLITPLAILDYRKAADNQNAPWEVLVQWQGLSPDETSWENWDQLKQEYHLEDKVIFQGPREVDSTKEAEIAKTKKSNRIAEIGVQAVSGKRKISKPAYLDEYV

SEQ ID NO: 233204 - protein, 241 aa, Glycine max
  Coding DNA Sequence Number=SeqID_116426
  Gene Ontology: Mol. function=transcription regulator activity; Cellular component=nucleus; Biological process=regulation of transcription, DNA-dependent
  Homolog annotation: Hit_ID=Q8W3M0; Match level="QueryCoverage=84%, HitCoverage=32%, E-value=2e-67, Identity=57%"; Hit description =Ethylene-insensitive-3-like protein
  Pfam annotation: Domain name=EIN3; Domain location=32-241; Score =164.8; E_value=2.3e-46; Accession=PF04873.4; Description=Ethylene insensitive 3
MDSMDDHNMTIDLLDTSMRTVEEESIEEEGMIEEEEDDDHNRQKQVLTIEELEKRMWRDQILLKKLKDERKEKEQGQTVEMMKKKALTRAQDIVLKNMLKMMEVCDVRGFVYGIIPDKGKPVSGASDNLRGWWKERVKFDRNGPAAMLRYDEETGFDDLGNEFRGDPSSAYRLSDLPDTTLGSLLSCLMQHCDPPQRRYPLDKGVPPPWWPTGFEIWWPELGFAADPGPPPYRKPHDLKKV

SEQ ID NO: 233205 - protein, 564 aa, Glycine max
  Coding DNA Sequence Number=SeqID_116427
TLARRLHPHLFPAQPIIRRPHHEIRGYDIEGSGARARNFLGGQSSHNPPPTSNVAAHSNNSMLLASGTARNFLGGLSSHNPQPTSNVGNGGARNFIGGQNYPPLNSNVDNGDGRSFLGGQNNPPPITSNFANGISNDNSMVTMNNGIVLPPDHGANKRKEVQGIPIPHETYSCHSPQCPYNETSFGFSDMNVRNNHQLACIYNNDNNNHNNAVQVVGGDGGGSSSSQLGRGNPKNNVNVALGQSMHTSAPVVNQSQTQNLPIGQPMNISAPVVSQNQALTIGQPMNISAPVVSQNQSLTTIGQPMNISAPVVSQNQSLTIGQPMSISAPVASQNQSLTIGQPPAVNNQNQTLNVISDNNNSGEIGSNGLMHNMNVVVPLGNQNQQQVQNVLQPQVVDSNNFFGGGRVSLDKNNNNLFGNNNMNINSVPPLLASQNMQQMQSVQPQVMDKNFYVGGRVSLDKNNNNLFDNNMNNFPPLESQNMQQLQNVHEPQVMDKSTFFGERIGGGYKLNNADQVHGDFSTLTSMDPSSYDQWDATNNSQSDFMDSPLLTAPLTAPSQDFLWL

SEQ ID NO: 233206 - protein, 952 aa, Glycine max
  Coding DNA Sequence Number=SeqID_116428
  Gene Ontology: Mol. function=RNA-directed DNA polymerase activity; Cellular component=chromatin; Biological process=chromatin assembly or disassembly
  Pfam annotation: Domain name=Chromo; Domain location=849-898; Score =35.3; E_value=2.2e-07; Accession=PF00385.14; Description='chromo' (CHRromatin Organisation MOdifier
  Pfam annotation: Domain name=RnaseH; Domain location=358-476; Score= -9.6; E_value=0.00045; Accession=PF00075.14; Description=RNase H
  Pfam annotation: Domain name=rve; Domain location=560-716; Score =104.5; E_value=3.1e-28; Accession=PF00665.16; Description=Integrase core domain
  Pfam annotation: Domain name=zf-H2C2; Domain location=508-542; Score =24.4; E_value=0.00021; Accession=PF09337.1; Description=His(2) -Cys(2) zinc finger
  Pfam module annotation: Pfam domain module=Chromo::RVT_1::RnaseH::rve: :zf-H2C2; Domain location=849-898::97-266::358-476::560-716::508-542
MVGNGQHLDCSAICEGVSILIQDVKFTLDLHVLPIVGANVSPSGLPPNRDTDHHIHLLPHTSPVNVRPYRYSHYQKKEIEQQVNDMLQKGLIRPSTSPFSSPVLLVRKQDGSWRFCVDYRALNAVTVRDRFPIPTIDELLDELGGAQYFSKLDLLQGYHQIHMHASDIPKTAFKTHHGHYEFKVMPFGLCNAPSSFQATMNNIFRQHLRHFIIVFFDDILVYSTSFEAHLHHLTITFQVLLDNNFVLKLSKCSFAQKQVEYLGHVVSHKGVEPVASKIEAIQHWPTPKSAKAVKSFLGHAGFYRRFIRNYATIAAPLVRLTAQDSFDWSPQTQEAFDHLKTALSTAPVLALPDFTIPFTVETDASGIGMGAVLTQKGHPVAFFSKPFTPELAVASTYVRELVAITTAVKRWRQYLLGQRFIIITDHRSLKELLTQVIQTPEQHKYLARLLGYDYVIQFRSGHQNQVADALSRQPESELSQCLVLSVPSLTFLEELHRQLEANPEFWGHAGITKTLARISENFTWTGLREDVKQFVTNCMDCQVTKYQTQRVAGLLCPLPVPHRPWEDLSLDFIVGLPAYLGNTTILVVVDRFSKGIHLGMLPTSHTAHMVASLFVDMVVKIHGIPRSLVSDRDPLFISKFWQELFKASGTHLRMSSAYHPQSDGQTEVLNRIVEQYLRAFVHKRPNRWGKLLPWIEWSHNTSWNAGTGTTPYEVTFGKKPFNFPEYITGTSNIEVVDHLLTDRDATFQTIRKKLLKAQEIMKRQADSKRRDAQYQKGPQPTAGKLAKRFYGPFQVEDRIGTVAYKLKLPDSARIHPVFHCSKLKPFRGNSEQHSELNLPPIFIHDQPVVHPLAILDSRKNPATGTWEVLIQWEGLSPDETSWEDWAQLQQDFHLEDKVRLQGPKSVMNREASGGDSMDITTTIEELPAHAIFQYPPADAAYLREAAITELVM

SEQ ID NO: 233207 - protein, 100 aa, Glycine max
  Coding DNA Sequence Number=SeqID_116429
  Homolog annotation: Hit_ID=Q9ZU94; Match level="QueryCoverage=98%, HitCoverage=36%, E-value=2e-17, Identity=46%"; Hit description =Expressed protein
  Subcellular localization annotation: CTP_CleavageSite=82; ConfidenceScore=5.91e-01
MPSPSSRWVLPMKTSTRSSPLPSTPSPSTSTTTLLSLPLVTPTTISCSVAATSPTINALIACHMQSPNSATFASPPVTAHCSSTTESSSTTMPPLSGLRM

SEQ ID NO: 233208 - protein, 163 aa, Glycine max
  Coding DNA Sequence Number=SeqID_116430
  Gene Ontology: Mol. function=transporter activity; Cellular component= integral to membrane; Biological process=transport
  Homolog annotation: Hit_ID=Q2PF04; Match level="QueryCoverage=99%, HitCoverage=38%, E-value=5e-44, Identity=52%"; Hit description =Putative transporter-like protein
MEEGTFEQPSLEKHYYGNCPGCKVDQAKELRKDVSIRNLSYIWMAVLCGTNPIQQSSITAPHDMHPQRALTSIFWGMLSDRYGRKPVIISGIITVVIFNTLFGLSTNLWMAISMRFLLGSLNGLLGPIKAYAAEIFREEKQALGLSNFVAAWGVGLVIGPALG

SEQ ID NO: 233209 - protein, 218 aa, Glycine max
  Coding DNA Sequence Number=SeqID_116431
MARYFGRGGPIGSPGWAARSCGCCRRQQAAPHGGRPEFLSYARPQVPGVLFFSYQKKSPSGATMAAMVTLIAGRGGAGSKGGRVGRGSAEAGRTRMGLGCGGGARERGGLRLNEGERLMSLDFSANLRCETGDEATQKERGWQSDNPIREVFKFRKQIASAGLVGIQATRNRGNGRGLWEGVLAVGENGGGTMQKFIELEVHRLHSVGEAGENGFQIG

SEQ ID NO: 233210 - protein, 65 aa, Glycine max
  Coding DNA Sequence Number=SeqID_116432
MDKDLPHRHMTDSENWILMVETYLHNGLFYMNGWFIAYVDIGDLRGWDNLCSGGVRGGHSREFES

SEQ ID NO: 233211 - protein, 241 aa, Glycine max
  Coding DNA Sequence Number=SeqID_116433
  Gene Ontology: Mol. function=nucleic acid binding; Biological process= DNA integration
  Homolog annotation: Hit_ID=Q1SXR1; Match level="QueryCoverage=86%, HitCoverage=16%, E-value=1e-19, Identity=29%"; Hit description =Integrase, catalytic region; Zinc finger, CCHC-type
  Subcellular localization annotation: CTP_CleavageSite=12; ConfidenceScore=5.15e-01
MPSTLQGPNKSRMSSSKGPRTKFGYNNNYDHIGKILRSLYRNWRPQVTTLRTLKNLDSTSLEELVSTLKVHEQELQQDEELKREKYLALSSQKNIKASSPREQFLRSLSKALKVDDSSDDESEEDSNEDELIFIPHKIHKMWRKKLGHFKSECPDLEKSQDNKKLFKTKEKKGLMSTWEDLDDTSSNEGSESDQEDELLKNQEFKGEPQDVVKLHEEIRTLKTTLSKFVNGTNNLNKLLGY

SEQ ID NO: 233212 - protein, 119 aa, Glycine max
  Coding DNA Sequence Number=SeqID_116434
  Gene Ontology: Mol. function=DNA binding; Cellular component =mitochondrion; Biological process=DNA integration
MALRKERLAQHYFVNTLSAFISASTKFEMSMMGELKFFLGLQIKLIPHQGIYIHQTKYVKELLKKFNMGDAKEMRIVMHSTTYLGLNEESMKVDGTQYRAMIGSLLYLTTSRPNIMFNF

SEQ ID NO: 233213 - protein, 130 aa, Glycine max
  Coding DNA Sequence Number=SeqID_116435
MGVSHPFAIPRHMKTRATKANPKIGDKEWAASFTRNKEDPASPSSDSKSIDDNSISPLHNHAPFTQSCPPPSPLNLDRFRRTVPREPLTDVQRETITIQATVEMKHDCEHTSSEAFKALLSDAIVHLPTP

SEQ ID NO: 233214 - protein, 181 aa, Glycine max
  Coding DNA Sequence Number=SeqID_116436
  Homolog annotation: Hit_ID=Q1SXA8; Match level="QueryCoverage=64%, HitCoverage=8%, E-value=2e-07, Identity=29%"; Hit description=Zinc finger, CCHC-type; Polynucleotidyl transferase, Ribonuclease H fold
MKHNKFLTKDSQDVENKGGSRWKNSSRSVPKEKKDKEKSSIIFYECKKLLHFKFECPELEKSQDKKKHFKTKEKKGLMSTWEDLDDTSSNEEEEEVNLCLIANTTSEEFESDQEDEVNLDDPESLKKAYHELLSNSSILSKAYKNLQKDFKNLSKDHMELEKNLQDKVGVSWDESTQTCNT

SEQ ID NO: 233215 - protein, 69 aa, Glycine max
  Coding DNA Sequence Number=SeqID_116437
GSEVASRDRSGVAAATCVTCVSSTFSPIINGFGWLPQMTHPPHAEVPGLWDLHLPCEKKIEFRARLPTQ

SEQ ID NO: 233216 - protein, 69 aa, Glycine max
  Coding DNA Sequence Number=SeqID_116438
MRSKDAEFILVGIKRCINKRNKLAQLGQAFHEEKVWRCRNLPFGGRATRDSRDACSTKGIRAESPPTFI

SEQ ID NO: 233217 - protein, 364 aa, Glycine max
  Coding DNA Sequence Number=SeqID_116439
  Gene Ontology: Mol. function=transporter activity; Cellular component= integral to membrane; Biological process=transport
  Homolog annotation: Hit_ID=Q9FA44; Match level="QueryCoverage=74%, HitCoverage=54%, E-value=1e-118, Identity=84%"; Hit description=TctA
  Pfam annotation: Domain name=DUF112; Domain location=102-364; Score =190.9; E_value=3.1e-54; Accession=PF01970.7; Description=Integral membrane protein DUF112
MAICAVMMLLRKPDSVQWPVASTLKKLLALCVMLIVYGWLFEKLGFALCTTLLTFGIGILFGARWWAAALSGAVMGISLFYAFDHLLDVTLPGFAVAMTPENLMIALIGCFIGTIVGLLPGLGPINGVAILMPLAFALHLPAESALILLATVYIGCEYGGRISSILLNVPGDAGAIMTALDGYPMAQQGKAGVALSISAVSSFIGSTIAIIGIILFAPILANWSLAFGPAEYFALMVFAIACLGSMMSHNPLKSFLAALIGLGMATVGVDANTGVYRFTFDSVHLSDGIQFVVVVIGLFSVSEILLMLESTSSGQKMVRASGRMLFNMKEAAQATGATLRASFIGFLSACCQVPVPPSPAPLPI

SEQ ID NO: 233218 - protein, 294 aa, Glycine max
  Coding DNA Sequence Number=SeqID_116440
  Gene Ontology: Mol. function=transporter activity; Cellular component= integral to membrane; Biological process=transport
  Homolog annotation: Hit_ID=Q21A62; Match level="QueryCoverage=99%, HitCoverage=67%, E-value=1e-121, Identity=69%"; Hit description =Major facilitator superfamily MFS_1
  Pfam annotation: Domain name=MFS_1; Domain location=18-292; Score =130.2; E_value=5.5e-36; Accession=PF07690.6; Description=Major Facilitator Superfamily
MTNTARSTRIKWWIAGLMWLAIAINYIDRTVLSAAAPHLITELDINPEMMGFIMAAFFWSYALLQIPAGWFADRFGQKKGLGIAVGWWSIATMAMGLATGFKSLLALRLALGVGEAAAYPSNAGITARWFPDRERATVSGLFDSASKFGGAVAMPLIVFMIALFDWRLTFLAIGAVGLIWVIAWYFIYAENPEDHKAISTDEVRLIRDGQAQKHGDKNVRPMKWYKLLRYRNIWAMCIGFFTINYTSYFFITWLPTYLVKDKGMDFLKMGMVAALPLICGMVIEVLAGWASDRM

SEQ ID NO: 233219 - protein, 46 aa, Glycine max
  Coding DNA Sequence Number=SeqID_116441
MGISMYSARLFHLEAGELITVLGHMSAKGATNALRKLLDQSVHIFR

SEQ ID NO: 233220 - protein, 103 aa, Glycine max
  Coding DNA Sequence Number=SeqID_116442
  Gene Ontology: Mol. function=pepsin A activity; Biological process =proteolysis
  Homolog annotation: Hit_ID=Q9LHE3; Match level="QueryCoverage=83%, HitCoverage=18%, E-value=2e-15, Identity=43%"; Hit description =Nucleoid chloroplast DNA-binding protein-like
VLKLKAQKPSHADEHALVQVPAADGGVPDHDFSQHDCFKSKLASGARVIAARDLVVVAALVADDVIELVADGGGVGDGGKGSGEGRVEDGVGITHAYKWITRV

SEQ ID NO: 233221 - protein, 79 aa, Glycine max
  Coding DNA Sequence Number=SeqID_116443
MAFIILRFMHSFHNSEIHAKAITQYPTPVQLVNPEQWDDQAPMLVQMVVDHQELELEMTEERALVMLAQGSDEGRKTKP

SEQ ID NO: 233222 - protein, 179 aa, Glycine max
  Coding DNA Sequence Number=SeqID_116444
  Gene Ontology: Mol. function=oxidoreductase activity; Cellular component=glycerol-3-phosphate dehydrogenase complex; Biological process=fatty acid metabolic process
  Homolog annotation: Hit_ID=Q8S1G9; Match level="QueryCoverage=65%, HitCoverage=39%, E-value=1e-33, Identity=59%"; Hit description =Putative S(+)-beta-hydroxybutyryl CoA dehydrogenase
  Pfam annotation: Domain name=3HCDH_N; Domain location=4-179; Score =171.1; E_value=2.8e-48; Accession=PF02737.8; Description=3 -hydroxyacyl-CoA dehydrogenase, NAD binding domain
MSEVKRIGVVGGGQMGSGIAQVAAMHDIDVLASRPRPSSSLQSLLFHLFLHQPFRFQKPHLSELIRTRQLAAGADALKRLRLTTDLEDLQLADLIIEAIVESEDVKKSLFAQLDRIANSSAILASNTSSISVTRLATPTSRPCQVIGMHFMNPPPVMKLIEIVRGADTSEETFVATKAL

SEQ ID NO: 233223 - protein, 126 aa, Glycine max
  Coding DNA Sequence Number=SeqID_116445
MVWAFKILCPFFNLRPSIPMFMYFFQMKLTGKINWVSLNNVSKKMFEFDSNMFHKFKDCFFKVKATNVVSDGLSLMYEENREPHSPFTGNWTSQDDVVKVTPVLPPSVATKKKHNKEVGVTGQRKK

SEQ ID NO: 233224 - protein, 82 aa, Glycine max
  Coding DNA Sequence Number=SeqID_116446
MAKWCNSFNVEDHINTMNRKKVIGKKNHNKEANELASKGLYSSMKMSNLGMVLGPTSHRNRKVEYHISEEKTHKPEPYGFGL

SEQ ID NO: 233225 - protein, 281 aa, Glycine max
  Coding DNA Sequence Number=SeqID_116447
  Homolog annotation: Hit_ID=Q8PGF3; Match level="QueryCoverage=34%, HitCoverage=43%, E-value=1e-34, Identity=72%"; Hit description=Outer membrane protein
MLLSVGRFQHGLPTALYRAQLDAAAAHMPAAGPERAKGRADHAEGPGRARREMPGCAGPGGRTATVPCAASSVGAGGAPTAVRSAMDGPDGAPAGVPPRVRPAPCAPGPARPVPGMRGQVVLFAQQHAQAAAAGITGDAGAVDAATDHQQADVLHRASASSRRSTRDRGLARLYIKAAKHGLGSTAGADAEADGPRIHLGFADLLAAHLHVRARTHVAGVSTGEPGGVDVHVHTDGADHALGILEADVGVSAVAQLLVAEARLVVAHAHERAEHVVSLAEV

SEQ ID NO: 233226 - protein, 71 aa, Glycine max
  Coding DNA Sequence Number=SeqID_116448
  Subcellular localization annotation: CTP_CleavageSite=26; ConfidenceScore=5.04e-01
MFPHGKMPKKRVFRPYPTLTYPTPLRGSGVSNHHSFFFIPLPLIFKKKKTPLMKNIQVLQALHGATSSSLT

SEQ ID NO: 233227 - protein, 317 aa, Glycine max
  Coding DNA Sequence Number=SeqID_116449
RVRWHAETNIVFCALLSSRGDGPDDMRRQIMVIPHTFSPFRHSRVQCHTETNVVFYALLSSRGSGPDDMRRQIMVIPHTFSPFRHSRVRWHTKTNVVFCALLSSRGGGPDDMRRQIMVIPHTFSPFRHSRIRWHAETNDVFCAFCHPEAAGPMTCRDKLWSFRTLFRHSDTVVSDDTQRLTSSSIAAGPMTCGNHLVPHILLMSSRGGEPEDMREPFGPTLFTFCHPEAAGPMTCGDQLWDSKSRGGRRQIMVIPHTFSPSRGDRVRWHAETNYGHSAPCHPGSIVSEDTQRQIMVILRLVPTKRNKFDSIRMMFRY

SEQ ID NO: 233228 - protein, 109 aa, Glycine max
  Coding DNA Sequence Number=SeqID_116450
MVMKYAVFHDIQPLTMHIDLTGTASMSKIYDDGYIPKHSVLELQKAWPGSEVRWVTGGHVSSFCPMVNSEGLLLKALIDYRGRSLHCDRDIAQAQEIVLQIVKILFFQL

SEQ ID NO: 233229 - protein, 93 aa, Glycine max
  Coding DNA Sequence Number=SeqID_116451
MACFMLTLIFERNSKGWKTHGTGDHTFERRLRLGGPLLKENIATMVLERSGSNSEEQPLKSHVAFYTGCTLRQVLARWGFVDLVWVGHILNSC

SEQ ID NO: 233230 - protein, 97 aa, Glycine max
  Coding DNA Sequence Number=SeqID_116452
  Subcellular localization annotation: CTP_CleavageSite=36; ConfidenceScore=5.04e-01
MSYNGLSWKEGLAEASSWFKQSGPLGPSRFFLQKVVASGGSNLARLGELGGKLLPYFAINGGRSEERRSSAFLALLILLKLLRKIVSVKKIQVEALP

SEQ ID NO: 233231 - protein, 167 aa, Glycine max
  Coding DNA Sequence Number=SeqID_116453
  Homolog annotation: Hit_ID=Q1S960; Match level="QueryCoverage=66%, HitCoverage=17%, E-value=5e-08, Identity=34%"; Hit description =Prefoldin
MMVAPSVTRIEASKELTDIETQRKQEANEFSFKLESTRRKLKEAIEEIDESKELEMKLVVTILDFMASLDVIRNELKHVTAETNRLKKKEGKVDSTVQNLNFKILRAKSKLEAVSAAEEKARSIVMSLSHTLEKLKTKTEEAKKENEDVSQEVAATNEYRFFILNYV

SEQ ID NO: 233232 - protein, 67 aa, Glycine max
  Coding DNA Sequence Number=SeqID_116454
  Subcellular localization annotation: CTP_CleavageSite=30; ConfidenceScore=5.61e-01
MKDSMTSQLQFSPTKSLAQKSIQKYQGNVSSSPRTSIKSYLSICKITSSKSSKATDDVANKPRTSIN

SEQ ID NO: 233233 - protein, 327 aa, Glycine max
  Coding DNA Sequence Number=SeqID_116455
  Gene Ontology: Mol. function=glutathione gamma-glutamylcysteinyltransf erase activity; Biological process=phytochelatin biosynthetic process
  Homolog annotation: Hit_ID=Q2QKL5; Match level="QueryCoverage=77%, HitCoverage=50%, E-value=1e-84, Identity=66%"; Hit description =Phytochelatin synthase PCS3-7N
  Pfam annotation: Domain name=DUF1984; Domain location=1-40; Score= -6.4; E_value=0.0061; Accession=PF09328.1; Description=Domain of unknown function (DUF1984)
MWYCATDYLQSCRHEGWSSVAKFLTKDVPQLLKSEDLKDIQEVLSLAFKSPPSELRGLITWIVEVRRQEDGNLTLSEEEKGRLVIKAHILEQIQTTGLFKHVTRWLDSKSSCCNTLANLGDKDMLPALAASVCCQAANLLTVCGRLGLLGGKCCSQIDVKHLNADSENPVTLVSGTVTTGGGSEQGVDVLVPLCQREPSRLCLSNEGHCIGMHPSTADVLTVLLLALPLHTWSGIKEEKLCVEALSLLATEDLPPLLQEEVFTNSSGSYLSISVDHLVHKKPMAVFNKGKSPSNCLSYESQFGCLCEEEYKDFDEVVAAASLVIPRC

SEQ ID NO: 233234 - protein, 337 aa, Glycine max
  Coding DNA Sequence Number=SeqID_116456
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HSS5; Match level="QueryCoverage=80%, HitCoverage=23%, E-value=3e-38, Identity=61%"; Hit description =Glycoside transferase, six-hairpin, subgroup
MDMHDHITTLSSRRDSQQRIRVIQSYKGTPTHRINMSHTEIPNWISAKDISLVTGGTVSSLSSYNPELPLQETLLWQGSFLDFWGVEQEKCPVEGDDVVFRKGWLAVVVGDNFDDEGEEADEEGTDNESAKCPDEDLATNNDATHIYVPFLLHFMFSFAQEPAMLGLIQSTSVQLMEIWWRSLWCESPASLPTDPYCAYSFSIPYDKHKIQILLAKLLNSRSLVRLNIQASSADPSFFRRGWLAVVAGDSFDDEGEEADEEGIDNESAKCLDEDLATNNDAAQIYVPFLLLFMFSFAQEPAMLGLIQSTSVQLMEIRWRSLWCESQAGLPTDPYCAY

SEQ ID NO: 233235 - protein, 459 aa, Glycine max
  Coding DNA Sequence Number=SeqID_116457
  Gene Ontology: Mol. function=monooxygenase activity; Cellular component=integral to membrane; Biological process=electron transport
  Homolog annotation: Hit_ID=Q1SJ90; Match level="QueryCoverage=98%, HitCoverage=92%, E-value=1e-145, Identity=52%"; Hit description=E -class P450, group I
  Pfam annotation: Domain name=p450; Domain location=34-459; Score =314.9; E_value=1.4e-91; Accession=PF00067.12; Description=Cytochrome P450
MMNDIQGYVPILLVWLASIILLQAIFKTSKFRLPPSPFALPIIGHFHLLKLPLHRSFQKLSNRYGPLIHIYIGSTLTVVVSSSEIAKEIFKTHDLSFSNRPANVAINYLTYNSSDFGFAPYGPYWKFMKKLCMSELLNGKMLDQLLPVRQEEIHRFLLMMKLKGEACEVVNVGDEFLKLTNSIVMRMAIGKSCFRNDDEAHKVTERIKESSKGIGKKLKVVHERFDTMMECIIREHEEARNKSTEKDAPKDVLDALLSISEDQNSEVKITRDNIKAFLVDMFTGGTDTTAVTLEWSLAELINHPTVMEKARKEIDSIIGKDRMVMEIDIDNLPYLQAIVKETLRLHPPSPFVLRESTRNCTIAGYDIPAKTQVFTNVWAIGRDPKHWDDPLEFRPERFLSNENESGKMGQVGVRGQHYQLLPFGSGRRGCPGTSLALKVAHTTLAAMIQCFELKAEEKG

SEQ ID NO: 233236 - protein, 121 aa, Glycine max
  Coding DNA Sequence Number=SeqID_116458
MDGMEHVVKHLRSENKICWTCRKRSCGRGLRSLPSGLPESSESYYWIIKIPTVHLNVEASLMMMNQVDSSSFDDDKKPKRMISRLSQQVQDRDKIKINFKIQEMTSRRIKIQEKMISQGKC

SEQ ID NO: 233237 - protein, 109 aa, Glycine max
  Coding DNA Sequence Number=SeqID_116459
MNCWNLDDPIVTFRGLRKARGKRSEAPSTSASEAPPGDQPSSSGGGGASTAQEPMTKEPTTPVPSPAAVEEETTPAQTPQPSPPSAPAPEETQPSALDINEDQPQEEQD

SEQ ID NO: 233238 - protein, 194 aa, Glycine max
  Coding DNA Sequence Number=SeqID_116460
LRTAKREEVEAPKEDEEVARREEHGWNKFRGALWGSNSELKLWKEERDQSREDNLILKDELKACFRSKKSLSQRLCETKTNMLAIISKYQEELNLATTHEHRVADEYAQVYAEKEARGRVIDSLHQEATMWMDRFALTLNGSQEIPQLLAKAKAMADTYSAPALYVGLVLCHGKPEGPYHLLNCTHGALRPQMR

SEQ ID NO: 233239 - protein, 138 aa, Glycine max
  Coding DNA Sequence Number=SeqID_116461
MEELINKTQLSPPKIIPTSSRRFGGSSTESHPYTLLLSFCSHEQGSRSSQQENISKHHELTHHSLFNTHIQQLFIIHPWIQSRQLRMMHAPDLNSPMQCGTYRIQYQGNSPKHVYTTPHLGNHAVFVEATQSCTVTPP

SEQ ID NO: 233240 - protein, 60 aa, Glycine max
  Coding DNA Sequence Number=SeqID_116462
MVIINSWAKRISTAKRSFSVLSAKENLAEHQHQSRALSAAGAFSQAKLETGPKPNFTYSP

SEQ ID NO: 233241 - protein, 46 aa, Glycine max
  Coding DNA Sequence Number=SeqID_116463
MEKWDLKWRRCWFEWEVPMVEEFQSAISRNPLSKVEGFVGLVRRWK

SEQ ID NO: 233242 - protein, 73 aa, Glycine max
  Coding DNA Sequence Number=SeqID_116464
  Homolog annotation: Hit_ID=O64438; Match level="QueryCoverage=46%, HitCoverage=14%, E-value=3e-12, Identity=91%"; Hit description=ARG10
SFYSTAVGGLRCYENPKNKITAVPAEEEQIWGAFFRNRESVTSPNSNIRLMSVETALGTKGKCEVILELKKLV

SEQ ID NO: 233243 - protein, 73 aa, Glycine max
  Coding DNA Sequence Number=SeqID_116465
MTKNNEVTSRQDARRSRIEVHAKCGCEDEEDHVGCSTVSLLFCERHDCFQSIILYCGIKTHIDSWDNPGGECR

SEQ ID NO: 233244 - protein, 135 aa, Glycine max
  Coding DNA Sequence Number=SeqID_116466
VHGYSTGLASSSSCSSSCRRINVSVYIEADTQGDTATIGIVARDKVDVTYETWKEVPAAQKDLIWEDIQAEFEIPEASDTDKDGVDDTVCEKYDINKEKWAQFCQTRRDPSWEDMRKKAQAIQKQNTAPHMLSRG

SEQ ID NO: 233245 - protein, 86 aa, Glycine max
  Coding DNA Sequence Number=SeqID_116467
MLIDREFNNNVLVHDIYEQSDHDGDPTTQPKDTLCDIGGPMTRSKTKRMKQALQYLIMEIKSSQGGLEATPHWVIFLQVDEDLSPN

SEQ ID NO: 233246 - protein, 186 aa, Glycine max
  Coding DNA Sequence Number=SeqID_116468
  Gene Ontology: Mol. function=protein dimerization activity; Cellular component=nucleus; Biological process=regulation of transcription, DNA-dependent
  Homolog annotation: Hit_ID=Q52MZ2; Match level="QueryCoverage=55%, HitCoverage=19%, E-value=3e-25, Identity=66%"; Hit description=TGA10 transcription factor
MASSSVKGNTNSTTTQIEPLPPPLHLHHQPPQHHFHHHQIPDQQISFGMLPSSSSASIPGNFLSKDSGAYDLGELDQAFFLYLDGQADPSSVQDQKQNSSSGMRPPPTLNIFPSQPMHAVPPSNSKVNMGLPSTQTSTGSKRQPETSMAKPKPHTEAAAAPEPPKAVKVHNLEYLRNVNYNKKIMH

SEQ ID NO: 233247 - protein, 204 aa, Glycine max
  Coding DNA Sequence Number=SeqID_116469
  Gene Ontology: Mol. function=protein dimerization activity; Cellular component=nucleus; Biological process=regulation of transcription, DNA-dependent
  Homolog annotation: Hit_ID=Q52MZ2; Match level="QueryCoverage=92%, HitCoverage=37%, E-value=3e-74, Identity=71%"; Hit description=TGA10 transcription factor
  Pfam annotation: Domain name=bZIP_1; Domain location=25-78; Score =24.8; E_value=0.00029; Accession=PF00170.11; Description=bZIP transcription factor
  Pfam annotation: Domain name=bZIP_2; Domain location=25-75; Score =27.1; E_value=6.1e-05; Accession=PF07716.5; Description=Basic region leucine zipper
  Pfam module annotation: Pfam domain module=bZIP_1::bZIP_2; Domain location=25-78::25-75
MDVLYQREGNLKGTTSSSEQEAPKTPDPKTLRRLAQNREAARKSRLRKKAYVQQLESSRIKLNQIEQELQRARAQGILMGGGNALLGGEQGFHMAMSGISSEAAIFDVEYARWLEEHHRIVCELRAVLQEHLHENELRLYVDNCLAHYDQVMNLKSMVAKTDVFHLVFGVWKTPAERCFMWIGGFRPSELIKIDLEINLRKGQK

SEQ ID NO: 233248 - protein, 139 aa, Glycine max
  Coding DNA Sequence Number=SeqID_116470
MGLASGSTSIPESIRTESLEVEFGNYTMIKMEESSGFPVLFGGENSNPPDDGGKDKILGLQLSARLQNNGLKDKIFLGLELIARLQHRTRGLRHLTRIHGVDLTNETQDTYLYLFHSPLLNAKYTQELIHINFGYYLMS

SEQ ID NO: 233249 - protein, 57 aa, Glycine max
  Coding DNA Sequence Number=SeqID_116471
MPWNLTDYLTMGVKYFEAVKQRLQAIKQWSPVETGVNLNGFSSNKKGMPQWFSINPP

SEQ ID NO: 233250 - protein, 63 aa, Glycine max
  Coding DNA Sequence Number=SeqID_116472
MGVATCTQHYCWGTQQTVKWRNCPSAIILPEEDNFRKNVIRNVSGRSFFRKNSSVFRKKLLPE

SEQ ID NO: 233251 - protein, 323 aa, Glycine max
  Coding DNA Sequence Number=SeqID_116473
MEKPPKVQRQEEHSKQYSSGSIWETHEGHFTVATAYPSGLHISKATDVKIVVDKVCPHLPIWDTSKNKGFKLHSYDEMPTRQMKVNVVNYSKNWSSFFSGKKLVQAPNIYNAKTFWNQIVWADTLKASSSNYDGSDNVDHHDFIQSLPTIFHETTYDLTKILEREFIDHVTYLHYAQKERIAKMEEELVFAIPVKEKTAQVQAEAFAKVMDDNIVHDFIIGLTNIGVMGETLKVSKAAKTDKVIHQEKEHAFKHSATSNKATLREKDALDVVIVYSTSSSPPTLNYALLTIVTKDQVQEMIGQAMDSFVERQRQENDQFKISL

SEQ ID NO: 233252 - protein, 346 aa, Glycine max
  Coding DNA Sequence Number=SeqID_116474
  Gene Ontology: Mol. function=DNA binding; Cellular component =endoplasmic reticulum membrane; Biological process=DNA integration
  Homolog annotation: Hit_ID=Q1S785; Match level="QueryCoverage=99%, HitCoverage=58%, E-value=1e-65, Identity=36%"; Hit description =Integrase, catalytic region
NLEKFDSKSDNGTFLGYFETSKAFRVYSSRTLAVEETIHLKFNENEPDNDLSKLDESFADLRLDDAIKKKESSNQSSEVRVSTHHLDDPQEEVREPTGCFIRRNHPESQIIDLLKGKKAVGAKWVFCNRLDENGNTVKNKASNMKLYQMDVKSAFLNGIIQEEVYVEQPRAFESDPHHVFKLNKALATNEMSCKGFSKLMRTEFKMSMMGELKFFLGLQIKQTSNGIYIHQTKYVKELLKKFNMNNAKEMKTPMHPITCHGLDEESAEMDRTQYRSMIGSLLYLTTFRPDIITSNLGLWFKRREDFRPTNFYEVDYAGDKVKRKNTSGNYHLIGGNLVTWICKKQG

SEQ ID NO: 233253 - protein, 242 aa, Glycine max
  Coding DNA Sequence Number=SeqID_116475
LALVKEFYANLYSSEGPSPKQVKIIGHLVRIDADNLNTFLETPVVLAEGETLPTYSKYYRSSTDIREIKASLCIPSRGFILNSEGHPGKILRKDLTTLAQVWSVLSYSNLAPTSHTLDLTVDRARLIFGLVSEMDMNVGALISGQITSMAQSNSSRLGFPALITALCKSRGVASDSLIFERLSSVINLAYIRKNYWNPDDLTVTIRGARKVRTRLVEAPSTSTAPPLAHTLTVPFVTAFADS

SEQ ID NO: 233254 - protein, 76 aa, Glycine max
  Coding DNA Sequence Number=SeqID_116476
MTTLTWIWMTLLFSNILPSDHNANLPLQMYQLGSRPQDTQWIRRSPTGPWGFQLWLRASVSPTGCPFPQRGHAIVT

SEQ ID NO: 233255 - protein, 52 aa, Glycine max
  Coding DNA Sequence Number=SeqID_116477
MRMRSPLKARACSPLQIDCPFEKGDNSCNLILSFANLSGNSLRVYILFDLVT

SEQ ID NO: 233256 - protein, 55 aa, Glycine max
  Coding DNA Sequence Number=SeqID_116478
MDYGLVSRDGEYPHYSPQRPHGGNNYSHCDNDYDGYNDGDDSDNDELTMILEKVI

SEQ ID NO: 233257 - protein, 296 aa, Glycine max
  Coding DNA Sequence Number=SeqID_116479
  Homolog annotation: Hit_ID=Q1RUD8; Match level="QueryCoverage=77%, HitCoverage=43%, E-value=4e-12, Identity=27%"; Hit description=IMP dehydrogenase/GMP reductase
VDWDQYLAGIGGSTINWFPRWKEGKEGVLFSCGDYPNVPLIGTRGCINYNPALAIRQLGYPMRGAPTEESLSPFLVRDFDAQSLKIVQRVHKEWGSPLRKDKELRGIRNGIIGGYHEWLRIRTRGLDWLSKLKIINEEIFEAPEEDEEVQALKSELGRARLAKEKFKTAATSIQKECAELREENAATAKALEQETKRARKEGNNELKLRREEKDQSRVHGMILKEELAACSRSKRSLAQHLEATEQSMLAIIGQYKEEGIDALHQEATMWMDRFTLTLNGSQDLPPLLAKAKAIAE

SEQ ID NO: 233258 - protein, 160 aa, Glycine max
  Coding DNA Sequence Number=SeqID_116480
  Gene Ontology: Mol. function=protein serine/threonine kinase activity; Cellular component=chloroplast; Biological process=protein amino acid phosphorylation
  Homolog annotation: Hit_ID=Q75W78; Match level="QueryCoverage=76%, HitCoverage=30%, E-value=6e-39, Identity=63%"; Hit description =Protein kinase
  Pfam annotation: Domain name=Pkinase; Domain location=1-160; Score= -64.5; E_value=0.0001; Accession=PF00069.15; Description=Protein kinase domain
  Pfam annotation: Domain name=Pkinase_Tyr; Domain location=1-147; Score=-85.7; E_value=3.3e-07; Accession=PF07714.7; Description =Protein tyrosine kinase
  Pfam module annotation: Pfam domain module=Pkinase::Pkinase_Tyr; Domain location=1-160::1-147
MQTELNMRRLSHPNLVNLLGYCWDDDEHLLVYEFMPKGSLDNYLFKRNRNLELLSWNTRLKIAIGAARGLAFLHASENNVIHRDFKSSNILLDGNYNPKISDFGLAKLGPSKGQSHNYNPKISDFGLAKLGSSEGQSHNYNPKISDFGLAKLGPSEGQSH

SEQ ID NO: 233259 - protein, 205 aa, Glycine max
  Coding DNA Sequence Number=SeqID_116481
MAYHASSKANQDSMKNHEIHFGKSYSIENFQGGPELQPYYQNEAERGSNLDKLLMQFKETTKSTQQPLQRVEIQVGELAKEMTQFMSRREKYFIEVEAQEESPVKEHESREKDEEQAQKQWEKYSSVENIQESILQINNLPHQRIDKKKRQGEHEETLSAILSLITNTFPEMIWNVLPDYMKFMEFLAKRRNCKEDVFYVTFMPP

SEQ ID NO: 233260 - protein, 71 aa, Glycine max
  Coding DNA Sequence Number=SeqID_116482
MACPKGQKVASGTYALVEEAEYWWENTRQCLDVEDCFTTRDPQSLNPFSDVRRRKEGISLERDRLNNGALK

SEQ ID NO: 233261 - protein, 54 aa, Glycine max
  Coding DNA Sequence Number=SeqID_116483
AKFSSSSPILLEPLAHDSCNWSLPMEDCITKGSNVETSINVSGEEHVAYVMSFP

SEQ ID NO: 233262 - protein, 146 aa, Glycine max
  Coding DNA Sequence Number=SeqID_116484
  Homolog annotation: Hit_ID=Q0YYZ4; Match level="QueryCoverage=48%, HitCoverage=18%, E-value=3e-16, Identity=55%"; Hit description =Ubiquinone biosynthesis hydroxylase, UbiH/UbiF/VisC/COQ6 family
MVQPPGDPGLFAAGRRGWPFRGRGVVAGPQPGRPLVDRRGSRLQPGPGGHQPAQPGPAGAARPPHGLAFASSLSIPSTSRGGPVPAFVPFSEVGKPVVPAALMNRPTRGERRFAYWALAECILAYYVGTDEGVSEVLHVAEKKGCT

SEQ ID NO: 233263 - protein, 335 aa, Glycine max
  Coding DNA Sequence Number=SeqID_116485
  Homolog annotation: Hit_ID=Q7N1W5; Match level="QueryCoverage=44%, HitCoverage=87%, E-value=1e-10, Identity=27%"; Hit description =Similar to hypothetical transmembrane protein of Ralstonia solanacearum
MAQQLQQRSGCPCGRQPFHVLADGRGDVEQMPLLEPENQQGREQLGDRPQFEHGMAINRCRPGCRSACSNAVSEPHPANVARLASADGADRPKPVASSAAHRRRRTGSWYMHVARSGVVVMVARTEGRPAQGAPGESTPTAAGDAQHAGGSSAMADSWHLATTQPPLIKGTAHEHAPATRLADADLGLAAPGLPGHPWHRRHEACRNLAAQTGNRARAVRRLGRVVDQSSLRRVAGRLERVACRHSHGRGTCLAAAESIEADAGSQHRQALAQRGLQPAAAAAGHLPGEVRLRSRICGVAVADLPCRFQCGLPAADGRVHWHLRRQVRPVPGLAA

SEQ ID NO: 233264 - protein, 403 aa, Glycine max
  Coding DNA Sequence Number=SeqID_116486
  Gene Ontology: Mol. function=hydrolase activity; Biological process =aromatic compound metabolic process
  Homolog annotation: Hit_ID=Q6YVH6; Match level="QueryCoverage=75%, HitCoverage=76%, E-value=1e-113, Identity=63%"; Hit description =Hydrolase, alpha/beta fold family-like
  Pfam annotation: Domain name=Abhydrolase_1; Domain location=155-389; Score=73.5; E_value=6.7e-19; Accession=PF00561.10; Description =alphabeta hydrolase fold
MVVVGAPRLHRRVVDLTKVKRLKRMAGEGGGTWQFRWRRRKAGLTGDEETSPMVLAVTISEQRNMVHWIRTLIKKVTGKQKQFAGRRATSGMKWNLGSGFERLPYKPEGYNYWTWRGHKIHYVVQGEGSPIVLIHGFGASAFHWRYNIPELAKKHKVYALDLLGFGWSDKALIDYDAMVWRDQVVDFVKEIVKEPTVLVGNSLGGFTALVAATGLPDLVNGVALLNSAGQFGDGKRESETSEETALQKFLLKPLKEVFQRVVLGFLFWQAKQPARVLSVLKSVYINSSNVDDYLVESITRPAQDPNAGEVYYRLMTRFMMNQSKYTLDAVLSELSCPLLLLWGDLDPWVGPAKANRIKEFYPKTTLVNLQAGHCPHDETPELVNKALLDWLTTLTPEVTLQTV

SEQ ID NO: 233265 - protein, 71 aa, Glycine max
  Coding DNA Sequence Number=SeqID_116487
MRLKTEAPELGVGGGGGVHFDAEREIEKKSVDNGDAVWAVVRALRNRGVKVFVAGDRNSVILTVNPKVKPK

SEQ ID NO: 233266 - protein, 112 aa, Glycine max
  Coding DNA Sequence Number=SeqID_116488
  Gene Ontology: Mol. function=nucleic acid binding; Cellular component= intracellular
  Homolog annotation: Hit_ID=Q9SJL4; Match level="QueryCoverage=96%, HitCoverage=98%, E-value=1e-42, Identity=64%"; Hit description =Expressed protein
MGGKCPHRNVKKRRYSHKTARRTKFELKGDDMVYAQLNKPDQERPPLPVDEDLPGMGHRYFANITVRDEHFKTKRHKKRIKQMMGPAPHTQLDADLASGMGMPDNGPKLMSM

SEQ ID NO: 233267 - protein, 813 aa, Glycine max
  Coding DNA Sequence Number=SeqID_116489
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=96%, HitCoverage=96%, E-value=0.0, Identity=62%"; Hit description =Multidrug resistance protein 1
  Pfam annotation: Domain name=ABC_membrane; Domain location=221-500; Score=174.3; E_value=3.1e-49; Accession=PF00664.13; Description=ABC transporter transmembrane region
  Pfam annotation: Domain name=ABC_tran; Domain location=2-104; Score =26.9; E_value=7.1e-10; Accession=PF00005.17; Description=ABC transporter
  Pfam annotation: Domain name=ABC_tran; Domain location=575-759; Score= 240.4; E_value=3.8e-69; Accession=PF00005.17; Description=ABC transporter
  Pfam annotation: Domain name=SMC_N; Domain location=568-763; Score= -134.1; E_value=0.087; Accession=PF02463.9; Description=RecFRecNSMC N terminal domain
  Pfam module annotation: Pfam domain module=ABC_membrane::ABC _tran::ABC_tran::SMC_N; Domain location=221-500::2-104::575-759::568 -763
MEFLKVKAYEVIGHTMHFKKIQKVGERGLQLSGGQKQRIAIARAMLKNPAILLLDEATSALDSESEKLVQEALDRFMIGRTTLVIAHRLSTIRKADLVAVLQQGSVTEIGTHDELFAKGENGVYAKLIRMQEMAHETSMNNARKSSARPSSARNSVSSPIITRNSSYGRSPYSRRLSDFSTSDFSLSLDASHPNYRLEKLAFKDQASSFWRLAKMNSPEWLYALIGSIGSVVCGSLSAFFAYVLSAVLSVYYNPNHRHMIREIEKYCYLLIGLSSAALLFNTLQHSFWDIVGENLTKRVREKMLAAVLKNEMAWFDQEENESARIAARLSLDANNVRSAIGDRISVIVQNTALMLVACTAGFVLQWRLALVLVAVFPVVVAATVLQKMFMTGFSGDLEAAHAKATQLAGEAIANVRTVAAFNSEKKIVGLFTSNLETPLRRCFWKGQISGSGYGIAQFALYASYALGLWYASWLVKHGISDFSNTIRVFMVLMVSANGAAETLTLAPDFIKGGRAMRSVFDLLDRITEIEPDDPDATPVPDRLRGEVELKHVDFSYPTRPDMSVFRDLSLRARAGKTLALVGPSGCGKSSVIALIQRFYDPTSGRVMIDGKDIRKYNLKSLRRHIAVVPQEPCLFATSIYENIAYGHDSASEAEIIEAATLANAHKFISSLPDGYKTFVGERGVQLSGGQKQRIAIARAFVRKAELMLLDEATSALDAESERSVQEALDRACSGKTTIIVAHRLSTIRNANLIAVIDDGKVAEQGSHSLLLKNYPDGIYARMIQLQRFTNNQVIGMASGSSSSARPKDDEREG

SEQ ID NO: 233268 - protein, 241 aa, Glycine max
  Coding DNA Sequence Number=SeqID_116490
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=98%, HitCoverage=98%, E-value=2e-77, Identity=64%"; Hit description =Transcription factor, MADS-box
  Pfam annotation: Domain name=SRF-TF; Domain location=16-66; Score =82.1; E_value=1.7e-21; Accession=PF00319.9; Description=SRF-type transcription factor (DNA-binding and dimerisation domain)
  Subcellular localization annotation: CTP_CleavageSite=27; ConfidenceScore=5.02e-01
MSGPKKSRGRQKIEMKKMSNESNLQVTFSKRRSGLFKKASELCTLCGADVALVVFSPGEKVFSFGHPNVDAVIDRYLGRAPPTESFIEAHRVANVRELNAQLTQINNHLNNERKRAEELNLMKKGAQAQLWWARPLDGMSIAQLKQFKAALEELKKQVARLADRAMLQSVTNPTLQFFPGVSSSSNSNLVHQQHPLQPQVFPPHLIQPPMLQHFMFHDGSMMRHHGFNNMGMGGYGPAFDS

SEQ ID NO: 233269 - protein, 907 aa, Glycine max
  Coding DNA Sequence Number=SeqID_116491
  Gene Ontology: Mol. function=porin activity; Cellular component =integral to membrane
  Homolog annotation: Hit_ID=Q6YWF9; Match level="QueryCoverage=89%, HitCoverage=60%, E-value=1e-145, Identity=38%"; Hit description =Nucleoporin-like protein
MGFLMVARSNLPFIASKEEIHQEEYDSVISFLQDDIFPFVSSIFLRRLLLPGVHHNATLYATLLEYSRHLGESELQTLTADGLKKEILSLIEHEKKSISLFRSLEDIERIVEVGSSEEVSELTGLVDIFNDDLDCDILIELLRCVISFSQQLGKTASSIFYESLLTTSVISSEDIVRYIVKILETGYCMSGPVLQTSTSGDHIVVLEKELADHKSLRKLSIDMFLSLQGLHKKASAWGRILKIAKVMFESAWDFLLFLSYLVDISGQVHLLHDDINKIQLDLVPMLQEIIFEWLIIIFFTITPSAPAVTEDFNSKLSSLQIDNNMGKRLWNEKLGRYDFTLAYTFLLNVGSSSLDHSHYSSEHFSNVQSFINKTRDFISWIIWGQTGGSSTFLTRSIDLAFILFKHDQYGAAEQLLMIAEAHLLKEKTSQSIQDDDGGWCIRHHLLGCCLLAQVQCGLHATQKDKKVSEAIRCFFRSSSGNGASEALQSLSDDLGIPYLGFNGCTSIAAWKLQYYQWAMQLFERYSISEGACQFALAALEQVDEALYMKDDKCTNNSVNESVTTIKGRLWANVFIFVLDLGRYYDAYCAIISNPDEESKYICLRRFIIVLYEQGAIKILCSNKLPLIGLVEKVEQELAWKAERSDISAKPNLYKLLYAFQLHRHNWRRAASYMYLYSARLRTEAALKDSVGSSLMLQERLNALSSAVNALHLVHPAYAWIDSLAEGSYLVNEYYPSKKAKRTPDEHSAADNDAEPQGWQSSIDIEKLENEFVLTSAEYMLSLNFDFVLKKGKHGALSDLADLLVQNNLYDMAFTILLRFFKGSGLKRYYSVFLFRELERVLSAISLKCCLDKVESSWVEEHSHLLTSSKHEMVAHGSPATVSTTPQTDRNSCWATLKLYLVRIFCYH

SEQ ID NO: 233270 - protein, 307 aa, Glycine max
  Coding DNA Sequence Number=SeqID_116492
  Gene Ontology: Mol. function=porin activity; Cellular component =integral to membrane
  Homolog annotation: Hit_ID=Q6YWF9; Match level="QueryCoverage=83%, HitCoverage=12%, E-value=3e-14, Identity=46%"; Hit description =Nucleoporin-like protein
MGTGSTLAGKEVPIVGSDAVRWIDLSVPSSSNIAAVDGVAALPTTDDRASCFVIGDPPTYLIWRIHKAQPQSLELLELAASKEFPRVGLRFTFPDALCPFAFIGKNEISGASRFPYLLYVLTVSGVAYLLKIRNVSAYTSVSVFPVDELLEVNVRDYIPNHATAITTVMATVGGLVVGTSDGSVFCFQLGVVDPSAPGFMHELRDEAGISRLWGLISRGKMVGTVQELVILELHEKKFVFVLHLDGTLRIWDLASRSRVFSNNMGTVTMAAGFHDLTQRFMKFMETGQALAGFDVIPVFWETFYFSV

SEQ ID NO: 233271 - protein, 643 aa, Glycine max
  Coding DNA Sequence Number=SeqID_116493
  Gene Ontology: Mol. function=pyruvate kinase activity; Cellular component=chloroplast; Biological process=glycolysis
  Homolog annotation: Hit_ID=Q84R73; Match level="QueryCoverage=79%, HitCoverage=93%, E-value=0.0, Identity=66%"; Hit description =Putative pyruvate kinase
  Pfam annotation: Domain name=PK; Domain location=96-446; Score=244.0; E_value=3.1e-70; Accession=PF00224.11; Description=Pyruvate kinase, barrel domain
  Pfam annotation: Domain name=PK_C; Domain location=463-577; Score =41.5; E_value=2.8e-09; Accession=PF02887.6; Description=Pyruvate kinase, alphabeta domain
  Pfam module annotation: Pfam domain module=PK::PK_C; Domain location =96-446::463-577
  Subcellular localization annotation: CTP_CleavageSite=59; ConfidenceScore=5.61e-01
MVLKSMVASASDLSLVSVAGNPPLDLKNRVFGSRVISLGFRFNKGSKWKGNERFNFKVRAAVEVGVERSKSKALEGGFGLDVVSEAELTVKGFAGLRKTKLVCTVGPACSSMEDLENLALGGMSVARLNMCHGTREWHRDVIRKIKKLNEEKGFCVSVMIDTEGSQIHVVDHGAPSSVKVEEGSNWVFTAEHYEGSRPFTVQTNYRGFSEGTEVGDELVIDGGMACFEVTEKTGNDLHCKCIDAGLFLPGAKFSFWRDGKLVRGNNKLPTLSTKDWADIDFGIAEGVDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQELKRRGMTPTSLLDDYKQSDYGLDEEVYVNEEDRGFPKRKAVSTNVERSLDNQRERSMALNSEGLE

SEQ ID NO: 233272 - protein, 221 aa, Glycine max
  Coding DNA Sequence Number=SeqID_116494
  Gene Ontology: Mol. function=kinase activity; Biological process =inositol and derivative phosphorylation
  Homolog annotation: Hit_ID=Q1T2N0; Match level="QueryCoverage=87%, HitCoverage=49%, E-value=2e-67, Identity=68%"; Hit description =Inositol 1, 3, 4-trisphosphate 56-kinase
  Pfam annotation: Domain name=Ins134_P3_kin; Domain location=20-221; Score=84.5; E_value=3.2e-22; Accession=PF05770.2; Description =Inositol 1, 3, 4-trisphosphate 56-kinase
MRLNGEISSGEEEEKQTGTTTFSSQKVVVGYALTSKKKKSFLQPSFTGLARNRGINFVAIDLNKPLLEQGPFDIILHKLSGEEWCEIIEFTTSVLWHGKQFSYRLKANNAAHQMHPFPKKDYRQKHPEVTVLDPPDAIQHLHNRQSMLQDVVDLNLSDCHGKVGVPRQLVIPKEKDPSSIPYEITKAGMKLPLVAKPLVVDGTAKSHELFLAYDEFSLSEA

SEQ ID NO: 233273 - protein, 284 aa, Glycine max
  Coding DNA Sequence Number=SeqID_116495
  Homolog annotation: Hit_ID=Q9LJM7; Match level="QueryCoverage=19%, HitCoverage=22%, E-value=6e-09, Identity=50%"; Hit description =Arabidopsis thaliana genomic DNA, chromosome 3, P1 clone: MMB12
  Subcellular localization annotation: CTP_CleavageSite=51; ConfidenceScore=5.23e-01
MSNNPQYPGLQPLRPPIAGSLDPPRNFVPPMPVQFRPAVPTQQSQQFISMPSQHYQHQPVGPGGVPLIGVGIPPQNQQPQFSQPIQQLPPRPSPQLPPPSQAIPMPVARPNMHIPSESMMQQSDSQAHSQAPNGYTPGLGGPGMPLSSSYTFAPSTYGQVQANFNSTGQFQPVPQIHALTGSSSQSITTGATLQSNGGQPLVTTVMPLATIAQPQLTKNGPTDWIEHTSATGRTYYAKISADSSVGVPLQVPNLPLQCLSLTGKEDHCLFNLDLGHREPYLSQR

SEQ ID NO: 233274 - protein, 150 aa, Glycine max
  Coding DNA Sequence Number=SeqID_116496
MPPRKRCASEPVSDEASTQPQNIALRGCGRGRDHGQGRCGRGGGMPEVEIPRATHRNPTLAQLTANMQNMQEILLQLVYVVGERSQQQAKQQQPPLIQSIVAEVPLSAFTKLNPPTLSGSNVHEDPQTFVDERRDDMRPCSLQDQLDHLF

SEQ ID NO: 233275 - protein, 95 aa, Glycine max
  Coding DNA Sequence Number=SeqID_116497
MIRTRGLGHALDTGIGRGRGGQNEHHVDDVPRWHRSPASDVPSMTMDVPATGVEDVVTGSVADDAEGFLGRLQDPSMLTSFAEHVAHNIWAGEAL

SEQ ID NO: 233276 - protein, 128 aa, Glycine max
  Coding DNA Sequence Number=SeqID_116498
MVSLTKKPNCDGWSPGEGENRSSGSHFDPQGETLREQKGGENRVVAFQVTKLETEGWNGLRRSRWRERRRRGAILAPRWRCVATPLTTRVGRLARASQGEPNPGFAGEMAVGKWRRWRRRVTLALMPT

SEQ ID NO: 233277 - protein, 488 aa, Glycine max
  Coding DNA Sequence Number=SeqID_116499
  Gene Ontology: Mol. function=structural molecule activity; Cellular component=protein complex; Biological process=microtubule-based movement
  Homolog annotation: Hit_ID=P14641; Match level="QueryCoverage=89%, HitCoverage=97%, E-value=0.0, Identity=93%"; Hit description=Tubulin alpha-2 chain
  Pfam annotation: Domain name=Tubulin; Domain location=49-246; Score =338.6; E_value=1.1e-98; Accession=PF00091.15; Description =TubulinFtsZ family, GTPase domain
  Pfam annotation: Domain name=Tubulin_C; Domain location=248-393; Score=268.1; E_value=1.8e-77; Accession=PF03953.7; Description =TubulinFtsZ family, C-terminal domain
  Pfam module annotation: Pfam domain module=Tubulin::Tubulin_C; Domain location=49-246::248-393
MRECISIHIGQAGIQVGNACWELYCLEHGIGPDGQMPSDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVTEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPTVVPGGDLAKVQRAVCMISNSTSVAEVFGRIDHKFDLMYAKRAFVHWYVGEGMEEGEFSEAREDLAALEKDYEEVGAESDVYQYRCGFNLDALLLCFAAPPDFAKAVGYSSRVDSLVVLLWNLTGPKI

SEQ ID NO: 233278 - protein, 477 aa, Glycine max
  Coding DNA Sequence Number=SeqID_116500
  Gene Ontology: Mol. function=protein binding; Cellular component =ribonucleoprotein complex; Biological process=mRNA processing
  Homolog annotation: Hit_ID=UPI00005DC1C7; Match level="QueryCoverage =88%, HitCoverage=47%, E-value=4e-79, Identity=41%"; Hit description =protein binding
  Pfam annotation: Domain name=FF; Domain location=215-267; Score=43.5; E_value=7e-10; Accession=PF01846.10; Description=FF domain
  Pfam annotation: Domain name=FF; Domain location=285-334; Score=24.8; E_value=0.0003; Accession=PF01846.10; Description=FF domain
  Pfam annotation: Domain name=FF; Domain location=359-415; Score=28.5; E_value=2.4e-05; Accession=PF01846.10; Description=FF domain
  Pfam annotation: Domain name=WW; Domain location=3-32; Score=38.8; E _value=1.9e-08; Accession=PF00397.16; Description=WW domain
  Pfam module annotation: Pfam domain module=FF::FF::FF::WW; Domain location=215-267::285-334::359-415::3-32
VDATTNWKEYTSPDGRKYYYNKITNESKWSIPEELKLAREQVEKAIVSGSRPEALLNSHPQPSPTPSATEATPNTDNSTLPSQGEPSSPVSVAPVVTTSISNPQSEMPSGPSLSTSANAITGAKVDELEAPVNTVTPSDTCVGSDKAVVTDINTAVTPMNDVNNDSAQDTLGSADRVPVEDKEDGKNDLIGEKSNDVAAETKAVEPEPPVYANKMAKDAFKALLESVNVGSDWTWDRVGKAVSIFENDERFKAVERDRDRRDMFESFLEELLNKERAKVQEERKRNIMEYRKFLESCDFIKASTQWRKVQDRLEADERCSRLEKIDRLEIFQDYLRDLEKEEEEQKKIQKEEVRKTERKNREEFRKLMGEHIASGILTAKTHWRDYYTKVKDLHAYVAVASNTSGSTPKDLFEDVAEELEKQVSQPSPAEKYSVLHQLVDVLAESYCRMSAEESAVLDSAETLPPYLSKIRIPTKAA

SEQ ID NO: 233279 - protein, 78 aa, Glycine max
  Coding DNA Sequence Number=SeqID_116501
ARIRLVGGGYANSAMQSVRGAPDSMRYAINSLGSRFDGGGCMNDNQFMGLRIRFEGGGYTKSARQAIRGAPVSMVEDA

SEQ ID NO: 233280 - protein, 178 aa, Glycine max
  Coding DNA Sequence Number=SeqID_116502
  Gene Ontology: Mol. function=cytosol alanyl aminopeptidase activity; Cellular component=cytoplasm; Biological process=peptide metabolic process
  Homolog annotation: Hit_ID=P29745; Match level="QueryCoverage=99%, HitCoverage=43%, E-value=1e-63, Identity=62%"; Hit description =Peptidase T
  Pfam annotation: Domain name=M20_dimer; Domain location=1-79; Score =7.5; E_value=0.024; Accession=PF07687.4; Description=Peptidase dimerisation domain
MVNALDLAMRFHAELPAKEKPQFTDGYEGFFHLHTIKGSVEHAELMYLIRDFDADSYEQRKQLLQEIGRRVSKGLQAECSIKVEISDSYRNMREKVEPHPHIIELALQAMRDCGIEPNVKPIRGGTDGSALSWKGLPCPNLFTGGYNYHGKHEFASLNVMPKSVEVIVRLAALAAEKK

SEQ ID NO: 233281 - protein, 68 aa, Glycine max
  Coding DNA Sequence Number=SeqID_116503
MQFKETTKSTQQALQSVEIQVGEMAEEVTQFMSRREKYFVEVEAQEESLVKEHESREKDEEKDEEQAQ

SEQ ID NO: 233282 - protein, 159 aa, Glycine max
  Coding DNA Sequence Number=SeqID_116504
MEQATIFLTSSGFLKNLLDGVVRLDYHLMTREVRLESLGQGNEWAELITSSITERYKSKGALGLDRLKDGSVVMVFLKARKAWMLAYVELLNFLYVGWAMHHPYDSAFVGVSFNPLFPEDFFLVRHMLGYALKLENYVVHMYLDISYDFLFEDSVHQSL

SEQ ID NO: 233283 - protein, 124 aa, Glycine max
  Coding DNA Sequence Number=SeqID_116505
  Gene Ontology: Biological process=regulation of transcription, DNA -dependent
  Homolog annotation: Hit_ID=UPI00005FA8BB; Match level="QueryCoverage =96%, HitCoverage=28%, E-value=3e-24, Identity=48%"; Hit description =COG3711: Transcriptional antiterminator
MQPGGGLLFRLFPQPVALNRVETRMLLQAILPGVVEQVMLQELAVARIEVAAEQRLAGVDRLCQRRRRGGIGRQRLPQARGEIAFDKPRAAAQGPPQPVDEAQALVEHAAPQLVAMVGIDGDLQ

SEQ ID NO: 233284 - protein, 245 aa, Glycine max
  Coding DNA Sequence Number=SeqID_116506
  Homolog annotation: Hit_ID=UPI00005DC1C7; Match level="QueryCoverage =65%, HitCoverage=11%, E-value=1e-11, Identity=31%"; Hit description =protein binding
  Pfam annotation: Domain name=FF; Domain location=53-103; Score=27.1; E_value=6.1e-05; Accession=PF01846.10; Description=FF domain
MQGVICLKTVKLLKLVLSVGSGHRSRHGRLLVFDELLERVKEKEEKEAKKRKRLADDFFHLLHSTKDFTVSSKWEDCRPLVEDSQEFRSIGDESLCKEVFEEYIAQLKEEAKENERKRKEERAKKEKDREERERRKGKQRKEKEGGRERGKDEAHKKDKADSDSMELTEIQTSKENKRSEDDNRKQRKKRQSPVYEMDKEKTKKSRRHASGHESDEGRHKRHKRDHRREGDLEDGEFGDDHVDRW

SEQ ID NO: 233285 - protein, 50 aa, Glycine max
  Coding DNA Sequence Number=SeqID_116507
MTKLPEQAGQASDVGTAARGPHAPENVKFRVLYHQRDPIILPPIFPRPNL

SEQ ID NO: 233286 - protein, 101 aa, Glycine max
  Coding DNA Sequence Number=SeqID_116508
MSNEASFKPNLNDWDLAKSMGVTCQIQEGIVVSKLTDMEERDKEEAKSGPKEKSVGSNQAAEKCKFGRFMVIPKKVVDKLVKLQRWFLWGGDTEQKIAWIS

SEQ ID NO: 233287 - protein, 110 aa, Glycine max
  Coding DNA Sequence Number=SeqID_116509
FFGISHLFITPKHPPVPQHDTYVEPDIPEVPVAPEAGPSHAPSDVEQPRHAVDACQAIAERLERLLNLRILTVGTEVHEIMEDCIRIARGVTSNGNVYVRARRRRRTNQS

SEQ ID NO: 233288 - protein, 74 aa, Glycine max
  Coding DNA Sequence Number=SeqID_116510
MGCSHHQEQRCVTVLVQDGIYVNFQGVSGLLETFQFMQQLQGLWTITVYMIQDSFILSRAAKAPQDKCTLHSAA

SEQ ID NO: 233289 - protein, 349 aa, Glycine max
  Coding DNA Sequence Number=SeqID_116511
  Gene Ontology: Mol. function=methyltransferase activity; Biological process=protein kinase C activation
  Homolog annotation: Hit_ID=Q00VQ4; Match level="QueryCoverage=64%, HitCoverage=77%, E-value=8e-25, Identity=32%"; Hit description =Homology to unknown gene
  Pfam annotation: Domain name=DUF558; Domain location=120-339; Score =217.4; E_value=3.3e-62; Accession=PF04452.4; Description=Protein of unknown function (DUF558)
  Subcellular localization annotation: CTP_CleavageSite=65; ConfidenceScore=5.28e-01
MVGFSRHKQKTILSLPEIATQPFLTKTRTITKLKSNWVRSEMLQTLGGVIPRFVSRSWLRNLTVRAMAFSSSSSDYGDQSRGGLPRFYSETLPPSKALSSSFFLLLSQLFPLSFMEGSVIRVQGDEFWHMTKVLRLTTNDRVQLFNGKGSLVEGCIQSIDRTGLDFVALNDLISIPPQNTQLHVFAGFGTLKGGRADWLVEKCTEFGANSVTPLLTEHSPSISENRVDRLKRVILAASKQSQRLHEMVLKHPIEIDDLLHLIAQSKLSLVATAKATPVLSALASLEKETSGLIIIGPEGDFTEKEVSMMMEAGATAVSLGPHRLRVETATIALLATVMLWSDSQQISVC

SEQ ID NO: 233290 - protein, 125 aa, Glycine max
  Coding DNA Sequence Number=SeqID_116512
MYGPVATSNSATSRAGLPNDSGDSVVTFDTCSRWIDGMAKITNAYDLSARKVIHTFGDIHKGHTEDYIAQKTLPVTLKYMDTLKGSMAESVMPCLFSFTDPTYMIQAIPSRSGSSLSGFLTWWTP

SEQ ID NO: 233291 - protein, 96 aa, Glycine max
  Coding DNA Sequence Number=SeqID_116513
MEPPIWINPSAVNNGKRKSVPLSGSDQGKKPKESSPEMLPEGEALGAKWRRRGAEEGEKGNELLKKKVLEGERDGAKENLNVEKHIAAAEVSAIGT

SEQ ID NO: 233292 - protein, 284 aa, Glycine max
  Coding DNA Sequence Number=SeqID_116514
  Gene Ontology: Mol. function=DNA binding; Cellular component=nucleus; Biological process=regulation of transcription
  Homolog annotation: Hit_ID=Q09GS2; Match level="QueryCoverage=54%, HitCoverage=62%, E-value=7e-45, Identity=61%"; Hit description =Transcription factor MYBJ7
  Pfam annotation: Domain name=Myb_DNA-binding; Domain location=32-77; Score=34.6; E_value=3.6e-07; Accession=PF00249.21; Description=Myb -like DNA-binding domain
MASVNLSQTGLKRCGKSCRLRWLNYLRPNLKHGEFSEGEDRIICTLFASIGSRWSIIASQLPGRTDNDIKNYWNTKLKKKMMGVKMNPSALKKPHQVNLSSMLQNSTPSSPFTSLSFKNNHNNSYYYQPHLPFTGSESMTYSSLLSDNYSTFESLQNYQVNNSGFMLGCETSCSSSSDGSCNNNQINHVKEAELGFIGDGTFCDQIIGGGFSYLNSGVELEDTQKLVPSNAGKVNSGVTDEESRLWGESPLEYGLEEIKQLISTSSCNNFMLDDSKTGEMAMYY

SEQ ID NO: 233293 - protein, 285 aa, Glycine max
  Coding DNA Sequence Number=SeqID_116515
  Subcellular localization annotation: CTP_CleavageSite=51; ConfidenceScore=5.42e-01
MPPAPFSDEVSPSPLFPWHYNNPLHAASPGPSPSTSVTAPMVKVKVSVFIVAVVGSSSAAYEIKLIRKLIVDQVDPYTTTFMRNLCGSSLTLLWIISFLTFVYCGSTQRLCGSSTANLCLLRNNEKAMRPMSSGDQLKAYADQKKPYKMHHHACKINGDEEERHSGMKEKGWAAKEVLKKKKKNGRKKEKTQSQRENGLLGRASLKGTKRFDYLTRDSKHSSSPREGKLVDGGRPGKFERAQEGVRLVFWLRATMLFFARIATKTHFKAFFNNRLRMCFVKYIFQ

SEQ ID NO: 233294 - protein, 166 aa, Glycine max
  Coding DNA Sequence Number=SeqID_116516
  Gene Ontology: Mol. function=binding; Biological process=metabolic process
  Homolog annotation: Hit_ID=Q6ZLQ1; Match level="QueryCoverage=67%, HitCoverage=20%, E-value=2e-12, Identity=37%"; Hit description =Putative pentatricopeptide (PPR) repeat-containing protein
MHHLPNQPILEGGTCRQKRDERIPIRLNKNLCHLRNNPERTTSTTLTHKPVNHRVIRNRIPHRTFIKDLSRITGIHLQKRVDNEDIGLKSTFYKVGMNLMAEFWKQKLGAGLEEEGEGEEREGSDEEVEEEEVGVGDLGEGKVGVAKKEMCDVMRNGSWWRPVTTI

SEQ ID NO: 233295 - protein, 342 aa, Glycine max
  Coding DNA Sequence Number=SeqID_116517
  Gene Ontology: Mol. function=diacylglycerol kinase activity; Cellular component=nucleus; Biological process=protein kinase C activation
  Homolog annotation: Hit_ID=Q8S7U9; Match level="QueryCoverage=70%, HitCoverage=46%, E-value=1e-50, Identity=43%"; Hit description =Putative pentatricopeptide repeat containing protein
  Pfam annotation: Domain name=PPR; Domain location=219-252; Score =19.2; E_value=0.015; Accession=PF01535.11; Description=PPR repeat
  Pfam annotation: Domain name=PPR; Domain location=255-289; Score =14.4; E_value=0.15; Accession=PF01535.11; Description=PPR repeat
  Pfam annotation: Domain name=PPR; Domain location=93-127; Score=49.3; E_value=1.3e-11; Accession=PF01535.11; Description=PPR repeat
  Pfam module annotation: Pfam domain module=PPR::PPR::PPR; Domain location=219-252::255-289::93-127
MSSLSTRFCKWMPGRAGCSLRVITEMTQVFVEPDGYTFVAFLSACSSFEDRLIGKVVHVLVYRKLDCLGGNVLLVNVEVARRLFDQMGGRDVVSWTAMISGYCHAGCFQEALELFVQLEELRMEPDEVVAVAPLSACAWLGALELGRRIHHKYDGESWQCGYHRGFACAVVDMYAKCGSIDTALDVFVNTSDDMKTTFLYNSIVSGLAHHGRGLKPDEVTFVALLCACGHSGLVDEGKRLFESMLSEYGVNHQMEHYGCMIDLLSRAGHLNEAYRLIQNMLLKANAVIWRALLSACKHDHGVRYVMLSNMPALMEKNDEAASVRKAIDNVVIQKPLAGATWK

SEQ ID NO: 233296 - protein, 392 aa, Glycine max
  Coding DNA Sequence Number=SeqID_116518
  Gene Ontology: Mol. function=translation elongation factor activity; Cellular component=plastid chromosome; Biological process =translational initiation
  Homolog annotation: Hit_ID=Q1SWR7; Match level="QueryCoverage=73%, HitCoverage=46%, E-value=1e-25, Identity=26%"; Hit description =Mitochodrial transcription termination factor-related
  Pfam annotation: Domain name=mTERF; Domain location=70-380; Score =125.6; E_value=1.4e-34; Accession=PF02536.5; Description=mTERF
MEIKWRNYDTCHNLELYINPTVQMSAKEGLNFVQHSQSPFLLPRICIPHNHDHLSSNMEITSSHNSGSMMWFFKDKGFDDNSAQGMFRKCRRLEGVHQERASENWDYLRSIGIEERKLPSIVSKCPKILALDLYEKIVPTVECLRTLGTKPNEVASAIAKFPHILSNSVEEKLCPLLAFFQTLGIPEKQIGKMILLNPRLVSYSIATKLTEIVNFLANLGLNKDGMIGKVIVRDPYIMGYSVDKRLRPTSEFLKSIGLSEADLQAVAVNFPAILSRDVNKLLVPNYAYLKKRGFEDRQIVALVVGFPPILIKSIQNSLEPRIKFLVDVMGRQVDEVIDYPCFFRHGLKRRIEPRYKLLKERSLNCSLSEMLDCNRKKFFMKFGLLEGHALSN

SEQ ID NO: 233297 - protein, 630 aa, Glycine max
  Coding DNA Sequence Number=SeqID_116519
  Homolog annotation: Hit_ID=Q10F03; Match level="QueryCoverage=22%, HitCoverage=25%, E-value=3e-14, Identity=36%"; Hit description =Isoamylase N-terminal domain containing protein, expressed
  Subcellular localization annotation: CTP_CleavageSite=40; ConfidenceScore=5.46e-01
MDSVWVCYFPSCTIFPCRQCKLSPTHLLQSSTSISLLRVRASQTTRAITRKSRRLKSDAEIRNDIREFLNSVGLPEDHIPSTKELLLHGWNDLANIVRRRGHKQIQELRTRSSLNDDADFLSAETSLDEGLDAANGFEDPLTGQSEKVDSLVDDIEALTEILLGSSSGSLYVDSSSSLGEGTNIAEEASTNIVEDGLSEVEDHAEVVNDVTEGNFYPTELTSVDNDYDSSIMRTEISGELPFEAVSSGNSEFEDSLVGKMVGEITLSLTESHSNTSCNDSNLDTEDKEFSHLEPLVGFPLEQKDLGALEGLNDSKDDIVEDVTTTSKVSVRENLSGDNKLDSVVHSAADSNSTNLDTLANLSLKEKVANFIQNGDLDPVEDHVSCISNGDGPQESKEYIESKLVVYMPPGTHLPEDNNVMAHGNSLTSKQVVPSGALDLDQPLWDDHLPHEDVTTHFNKDLDTEAPKVPNEIEINHLKFMLYQKESELSWLKEQIDKKKLALSVLQTKAEAEISKARKLISEKDAELHVAEGSLSELKEVQIEFCGDGDVVELAGSFNGWHHRIELDPQQSTSALDLDGSRSSRCWSTMLWLYPGVYEIKFVVDGKWITDPQRESVTRGHIRNNILRVDR

SEQ ID NO: 233298 - protein, 116 aa, Glycine max
  Coding DNA Sequence Number=SeqID_116520
MATCVGTLEEFLMVVLGVGGWVEVGHGGVEWLTAGVVLGGLGGMAMKPHAYPSKSVPILIGNTQVDRTGIPISDKYGDGVTNFNSSDIGGVEIGKGNNTRLCPVAMSNLKCAHVAK

SEQ ID NO: 233299 - protein, 100 aa, Glycine max
  Coding DNA Sequence Number=SeqID_116521
MADGRTWQKAQIPPYKHATVPYGAAMAGLPSQISYGDMELPFEVEDVPTNDLAFRSHISHTMIIYNMHKPCEDMEEKAEADVEPVPADPVKPGNVDVKQD

SEQ ID NO: 233300 - protein, 710 aa, Glycine max
  Coding DNA Sequence Number=SeqID_116522
  Gene Ontology: Mol. function=voltage-gated potassium channel activity; Cellular component=membrane; Biological process=potassium ion transport
  Homolog annotation: Hit_ID=Q1RYP3; Match level="QueryCoverage=99%, HitCoverage=99%, E-value=0.0, Identity=76%"; Hit description=Cyclic nucleotide-binding; Ion transport protein
  Pfam annotation: Domain name=Ion_trans; Domain location=128-395; Score=39.0; E_value=1.6e-08; Accession=PF00520.21; Description=Ion transport protein
  Pfam annotation: Domain name=cNMP_binding; Domain location=499-599; Score=33.7; E_value=6.6e-07; Accession=PF00027.19; Description =Cyclic nucleotide-binding domain
  Pfam module annotation: Pfam domain module=Ion_trans::cNMP_binding; Domain location=128-395::499-599
MVSDRSKSVRFQDELETNKLMDNNKESHLSMVSFNEVSNDKQKGGKDAIGNKSSEDGRELSRVFSEDYDAAEILVLDPRGHRVNTWNKIFLAACLLSLFVDPLFFYLPVAKKDKCIDMSVGLEVFLTIIRSLIDAFYIIQIYFRFQTAYIAPSSRVSGRGELIIDSSKIASKYMRRDFWLDLMAAQPLPQVLIWAVIPNLKGSQMIASRHILRLASIFQYLLRLYLIYPLSSEIVKANGVMMEKAWAGAAYNLMLYMLASHVLGSSWYLLSIERQNECWKKVCTLQYPHCQYRYLDCQSMGDPDRIAWLRSSNLSSLCDQSSDFFQFGIFADALNLEVTASKFFNKYCYCLWWGLRNLSSVGQNLLTGTRVAEINFAVIIAVLGLVLFALLIGNMQTYLQSTTTRLEEWRIRRTDTERWMHHRQLPRYLKQNVRRHEQFRWVATRGVDEETILRDLPIDLRRDIKRHLCLNLVRQINEVPLFDQMDERMLDAICERLKPSLFTPGACVVREGDLVNEMLFIVRGRLDSCTTNGGRTGFFNTCRLGSGDFCGEELLPWALDPRPTVVLPSSTRTVKAITEVEAFALIAGDLKFVAAQFRRLHSKQLRHTFRFHSHQWRTWAACFIQAAWFRYKRIKETSELKRKENLMMAFVPGTTGSEHFSAPLQAPKGTMYAAKLASSPRKGRSLRYGPELDILGSLRKPLEPDFTDDE

SEQ ID NO: 233301 - protein, 73 aa, Glycine max
  Coding DNA Sequence Number=SeqID_116523
  Subcellular localization annotation: CTP_CleavageSite=51; ConfidenceScore=5.33e-01
ISSIARSQRQVMHQLDNLNNLLRGSLGEKSRPTRTNSGKSITMSSDSMGACVMAVVTVGCLGIFLMKGFLNKK

SEQ ID NO: 233302 - protein, 242 aa, Glycine max
  Coding DNA Sequence Number=SeqID_116524
MMERDNVEHHDFVQVLRPVKTYHFDDACVYFTKDTNTYAFITRLKNLPIIFHETTYYLTKIDERDFRDHAKVAGKAVDENIVNEVIIDLTNTGVMDENSKASKEAQADEVISRQQEPMFKKSETSHEVMSKEKDVPEVVIVYSASSSPIPIKYAPPNDVTRDQVQDMISQAMDTFAERQRQENYCCGTPVVANFITTLVERPTPSIQQPPALDQPPTSVPFVAAKHTLSAPKHPFPSPQVQQ

SEQ ID NO: 233303 - protein, 70 aa, Glycine max
  Coding DNA Sequence Number=SeqID_116525
MVVMEMFDDVGVTYLRERRMRAMFGGLMAATLGWCLVVVVMGLGERDRKRLLAFIKFRPSSFQNSNHHLF

SEQ ID NO: 233304 - protein, 74 aa, Glycine max
  Coding DNA Sequence Number=SeqID_116526
  Homolog annotation: Hit_ID=Q1SDG1; Match level="QueryCoverage=98%, HitCoverage=6%, E-value=1e-09, Identity=41%"; Hit description =Integrase, catalytic region; Zinc finger, CCHC-type
MEEEYSTNKPPLFKGIKYDYWKEHMIAHLEFIHIDLWEIVEHGNYILLDNQLNEVPKTSWTNTQRQKFPLKSKA

SEQ ID NO: 233305 - protein, 48 aa, Glycine max
  Coding DNA Sequence Number=SeqID_116527
MDFMVWEWKIFHILGQSETTSKQDGVSASNSKNFNSVATKLIWFEVNC

SEQ ID NO: 233306 - protein, 82 aa, Glycine max
  Coding DNA Sequence Number=SeqID_116528
YIHVVVQRQQGMAHPLWIFAGKGFYKVEKKSQGPQVAWGLDVGTGAAPKIPWVLKVQPPKFLGLGPSLDKSESHKIWKKAFF

SEQ ID NO: 233307 - protein, 86 aa, Glycine max
  Coding DNA Sequence Number=SeqID_116529
MTGFHRFFGRFPQINIGGDSAHFLPLEDALVSLASLARKRVGCDSWRLHWGLFSPTGLSKKGPYTRVHGNLRSGGESMVMLGLRLA

SEQ ID NO: 233308 - protein, 49 aa, Glycine max
  Coding DNA Sequence Number=SeqID_116530
MNLGIPQSCGSACHQTLGSRISFLNDHIEETLGPTKIGENHSKCINLTQ

SEQ ID NO: 233309 - protein, 218 aa, Glycine max
  Coding DNA Sequence Number=SeqID_116531
  Homolog annotation: Hit_ID=Q9PEX1; Match level="QueryCoverage=66%, HitCoverage=50%, E-value=9e-18, Identity=38%"; Hit description =Soluble lytic murein transglycosylase
  Pfam annotation: Domain name=SLT; Domain location=125-218; Score =73.0; E_value=9.7e-19; Accession=PF01464.10; Description =Transglycosylase SLT domain
MPRRPLLLALLLLPSLWPGLAAARTVYRCVQGNTVSLATAPEPGSRCTPKEIDDNAIQTPNLWGNMGVFSGVLYEREQDGALVYSTRNLPGSRVFLKFTMATPPGEPAHEGLGKVGKPQLAQHAKQFRAAAKATGVDDAWLRAIAHAESNFDALAVSSKGAQGVMQLMPDTAQEYGVNDPFSPQQSIDGGARYMRALLRRYNGDRPLAAAAYNAGIGA

SEQ ID NO: 233310 - protein, 177 aa, Glycine max
  Coding DNA Sequence Number=SeqID_116532
  Gene Ontology: Mol. function=transporter activity; Cellular component= integral to membrane; Biological process=transport
  Homolog annotation: Hit_ID=Q2PF04; Match level="QueryCoverage=99%, HitCoverage=22%, E-value=2e-25, Identity=47%"; Hit description =Putative transporter-like protein
MFPKDSFWDRFPYFLPCFIISAFAFASGIACIWLPETLHNHKSSSESTNSVEALEMESNETNNDKMISASLQETLHNHNGGSIESTINVKALEIGSNEANKDKTIQKDKSIFQNWPLMSSIIVYCVFSLHDVAYQEVVFLLNDFSILTLSLTYTNLLSIYHSRFSHCGLSVPEDWVV

SEQ ID NO: 233311 - protein, 435 aa, Glycine max
  Coding DNA Sequence Number=SeqID_116533
  Gene Ontology: Mol. function=transporter activity; Cellular component= integral to membrane; Biological process=transport
  Homolog annotation: Hit_ID=Q2PF04; Match level="QueryCoverage=99%, HitCoverage=89%, E-value=1e-159, Identity=61%"; Hit description =Putative transporter-like protein
  Pfam annotation: Domain name=MFS_1; Domain location=42-435; Score =103.1; E_value=8.5e-28; Accession=PF07690.6; Description=Major Facilitator Superfamily
  Pfam annotation: Domain name=Sugar_tr; Domain location=41-397; Score=- 151.3; E_value=0.039; Accession=PF00083.14; Description=Sugar (and other) transporter
  Pfam module annotation: Pfam domain module=MFS_1::Sugar_tr; Domain location=42-435::41-397
MEEEAFEKPLLKRQYHENCPGCKVDQAKELKKDVSFRNLSYIWLAVLCGTLPVASLFPFVYFMVKDFNIAETEEDISTYAGYVGSAMMLGRSLTSILWGMVSDRYGRKPVIIIGIITVVIFNTLFGLSTNIWMAVSMRFLLGSLNGLLGPIKAYATEIFREEEQALGLSTVVAAWGVGLVIGPALGGYLAQPVLKYPHIFPKDSFWDRFPYFLPCLLVSAFAFASAIACIWLPETLHNHKDRIESTKNVEALEVGSSEADKDRIIQRDKSIFRNWPLMSSIIVYCIFSLHDVAYQEIFSLWALSPLRLGGLNFTTDDVGNVLAISGLAILVFQLTLYRLVQKACGPVALVRIAGVLSIPLLQCYPLMTMLSGFTLDIVINIASILKNVLIEAIATSLFILQNKAVEQHQRGTKNSIAMTGMSAFKTIGPASAGAL

SEQ ID NO: 233312 - protein, 189 aa, Glycine max
  Coding DNA Sequence Number=SeqID_116534
  Gene Ontology: Mol. function=transporter activity; Cellular component= integral to membrane; Biological process=transport
  Homolog annotation: Hit_ID=Q2PF04; Match level="QueryCoverage=82%, HitCoverage=31%, E-value=2e-51, Identity=61%"; Hit description =Putative transporter-like protein
MGFYRQTHFLCNLLSPRTALEHKLVYINKRPYGIAIIIFQLALYPSVQKAFGPVNLARFAGVLSIPLLQSYPFMTKLSGFTLHLVIIIASILKNILTESIATSLFLLQNRAVEQHQRGAANGFVMTCMSAFKTVGPASGGAILTWSEKHIHSFFLPGTHIVFLALNVVEGLGVLLMFKPFLSVKKKTPS

SEQ ID NO: 233313 - protein, 216 aa, Glycine max
  Coding DNA Sequence Number=SeqID_116535
  Gene Ontology: Mol. function=transmembrane receptor activity; Cellular component=membrane; Biological process=defense response
  Homolog annotation: Hit_ID=Q1SI46; Match level="QueryCoverage=92%, HitCoverage=23%, E-value=7e-55, Identity=50%"; Hit description =Leucine Rich Repeat, putative
  Pfam annotation: Domain name=NB-ARC; Domain location=2-216; Score= -84.7; E_value=6.9e-05; Accession=PF00931.13; Description=NB-ARC domain
MWEKLASPSMVQVPNDAELLEDIIDHVLKRLNKKPINNSKGLLGIDKPIADLESLLRQESKDVRVIGIWEDVKINTTNGLPNDILRRIGRMKIFIVLDDVNDYDQVEKLVGTLDWLGSGSRIIITARDRQILHNKVDDIYEIGSLSIDEAGELFCLNAFNQSPLGEEYWDYLLLSYWMVDYAKGVPLVLKVLGQLLRGKDKEVWKSQLDKLQKMPN

SEQ ID NO: 233314 - protein, 262 aa, Glycine max
  Coding DNA Sequence Number=SeqID_116536
MGTRGCISYNLVLAIRQLGYPMRGAPLEEELAPVISRGFNKTNMETLRKVRKTGEVLQKKDKELRGSNNGPIGGYRKTTKREEFEAPEEDEEVQALRAELEQAQIVKERACREEHGRNKFRGALWGSNSELKLQREERDQSRVDSLILKDELKACSRSKRSLSQRLCETETNMLAIITKYQEELNLATVHEHRVADEYAQVYVEKKARGRVIDSLNHEATMWMDRFALTLNESQELPRLLAKAKAVADTYSAPEEIHGLLDY

SEQ ID NO: 233315 - protein, 84 aa, Glycine max
  Coding DNA Sequence Number=SeqID_116537
QEAATPERSPYISPNPPSSMVVQYSPQQLVNPPTLVHEIPADPSTPLLEIPEDPATPVLGLTTTPPDTPLIYFSDEEGTQDQDT

SEQ ID NO: 233316 - protein, 201 aa, Glycine max
  Coding DNA Sequence Number=SeqID_116538
  Gene Ontology: Mol. function=oxidoreductase activity; Cellular component=vacuole; Biological process=hydrogen peroxide catabolic process
  Homolog annotation: Hit_ID=Q96519; Match level="QueryCoverage=91%, HitCoverage=54%, E-value=2e-71, Identity=71%"; Hit description =Peroxidase 11 precursor
  Pfam annotation: Domain name=peroxidase; Domain location=48-200; Score=170.9; E_value=3.1e-48; Accession=PF00141.13; Description =Peroxidase
MNPSFPSKSFMYVVLIFCFLGATRLYASDPYLTLDYYASSCPTVFDIVRKEMECAVLSDPRNAAMIVRLHFHDCFVQGCDGSVLLDDTITLKGEKNAATNIHSLKGLGIVDKIKNIVESECPGIVSCADILTIAARDAVILVGGPYWDVPVGRKDSVTANFDLANTNLATPDESLLSIIAKFLYQGLSVTDMVALAVSIII

SEQ ID NO: 233317 - protein, 63 aa, Glycine max
  Coding DNA Sequence Number=SeqID_116539
MVFGDEFRGGSRRFREVGEQRCSVFESGGGFAALAGFGVTTATTTVTKVASARVGCSGVETEN

SEQ ID NO: 233318 - protein, 81 aa, Glycine max
  Coding DNA Sequence Number=SeqID_116540
MGIKTKKTKRYNFEKVRLNDVGGCQAVTKGCWCKDNIEKGLTSHFEATSKCCDPKPINEVAKLVEGTLDDEMREIMNKDFT

SEQ ID NO: 233319 - protein, 45 aa, Glycine max
  Coding DNA Sequence Number=SeqID_116541
FWEKGGGSRNQSQLCACVGFFLSIDTICNVIVSCRVIPKTLMPRE

SEQ ID NO: 233320 - protein, 128 aa, Glycine max
  Coding DNA Sequence Number=SeqID_116542
  Subcellular localization annotation: CTP_CleavageSite=28; ConfidenceScore=5.42e-01
MSAVVAGSSSSMSATFTTRRSPFLKNSQGSHSKAVTSPQCQLYYFYYFGRKKKLYYRREEIQGKKGMTCLRTEKDKDEDEDEDVHLAPDSADDAPRTIPQQGSSEQVNVVPSRPSAHIVGIINKNWHS

SEQ ID NO: 233321 - protein, 126 aa, Glycine max
  Coding DNA Sequence Number=SeqID_116543
  Gene Ontology: Mol. function=ribonuclease activity
  Homolog annotation: Hit_ID=Q9SHL7; Match level="QueryCoverage=66%, HitCoverage=9%, E-value=2e-29, Identity=72%"; Hit description =Putative mitotic control protein dis3
MLTNKYCGSLEPMPMPAGSSGIAHALFVSKDRRIPNIRIQTRQLENLLDKRIIVAVDSWDRQSPYPLGHYVGTIWEIGDRDTEIKLLRYQQAYVIYNKMEKFSSDWCTNMFGPARSTYLLVIGVSG

SEQ ID NO: 233322 - protein, 139 aa, Glycine max
  Coding DNA Sequence Number=SeqID_116544
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q6S7C3; Match level="QueryCoverage=70%, HitCoverage=35%, E-value=3e-13, Identity=41%"; Hit description=TFIIE- alpha 2
MITSGVNLTKEQHGEVKQETKMDGTSTSTTAQNTDDKKSKIGHDNNQNIQDKYIKAYYAALLKQQHKLEEVAKKQLSNTFAAANPSSSTSNRQVGMKSKCEEDDDDTEWEEAPIAGSAIYTHCNVFVTFSTNMVLCCTN

SEQ ID NO: 233323 - protein, 285 aa, Glycine max
  Coding DNA Sequence Number=SeqID_116545
  Pfam annotation: Domain name=Transposase_23; Domain location=64-127; Score=-8.9; E_value=0.011; Accession=PF03017.5; Description =TNP1ENSPM transposase
MKHELKHAIKLELSQIVSQHSPPLEAPDIQVLAARVSMKGSCAKAGTIPSVKEPSDVHVDTMGLYVVHDQCTQLVALGKVYESVSIIHNVPYADDVVRVSVVKVYHCDAQVPLPTPKIQFVRQAIGTFVGWPTHLVKAVPNEDSQKGMSKRVTSATMDNTVAAVDPLGELVKNLFDVYQKPIQLPWDGAKFGIHNVKEGFFITHADVTEIILGDKCLNISILQLSTMFMNYWSTCLDYGSLHGFLEPQCIHKAKDKRQECEQYIQTWVKESQKQVYLGAYLNQAH

SEQ ID NO: 233324 - protein, 589 aa, Glycine max
  Coding DNA Sequence Number=SeqID_116546
  Gene Ontology: Mol. function=signal transducer activity; Cellular component=membrane; Biological process=response to light stimulus
  Homolog annotation: Hit_ID=Q1SGZ1; Match level="QueryCoverage=98%, HitCoverage=94%, E-value=0.0, Identity=70%"; Hit description =BTB/POZ; NPH3
  Pfam annotation: Domain name=BTB; Domain location=23-126; Score=13.9; E_value=0.00022; Accession=PF00651.21; Description=BTBPOZ domain
  Pfam annotation: Domain name=NPH3; Domain location=212-480; Score =359.2; E_value=6.5e-105; Accession=PF03000.5; Description=NPH3 family
  Pfam module annotation: Pfam domain module=BTB::NPH3; Domain location= 23-126::212-480
MAFMRLGSKSDAFHREGQTWNCTTGLPSDVTVKVGETSFFLHKFPLLSRSGLLKKLIADFTNEEGSNCVLQLDDVPGGDKTFELVTKFCYSVKIEVTASNVVSLRCAAEHLQMNETYGEGNLIARTEAFLNEVFSNWSDSIKALQTCEEVKSCAEELHIVSRGIDSLAVKACSNPNMSNRHVEGQDFSKNSAQDPALWNGISSENKSPPPGDDWWYDDLSSLSLPLYKRVILSIEAKGMKPENVAGSLIYYIRRFIPMMNRQTSFNDKNSANQGTTTNSPISEADQRVLLEEIMGLIPNKKGVTPSKHLLRLLRTATILHASPSSIENLEKRIGSQLDQAELVDLLIPNMGYSVETLYDMDCIQRIIDHFMSIYQASTASTSPCIIEDGPLIAGTDALAPMTMVANLIDAYLAEVAVDVNLKFPKFQALASAIPDYARPLDDALYHAIDVYLKAHPWLINSEREQFCRLMNCQKLSLEASTHAAQNERLPLRVIVQVLFFEQLRLRTSISGWLYVSANIENSQNHSGNLGLPKGNGSGQLDPTQGAENLRDLVSELEKECSCIRSEIQKLAKTKKSWSIIPKIFCRKNS

SEQ ID NO: 233325 - protein, 140 aa, Glycine max
  Coding DNA Sequence Number=SeqID_116547
  Gene Ontology: Mol. function=diaminopimelate decarboxylase activity; Biological process=lysine biosynthetic process via diaminopimelate
  Homolog annotation: Hit_ID=Q9LUL0; Match level="QueryCoverage=91%, HitCoverage=23%, E-value=5e-23, Identity=49%"; Hit description =Similarity to diaminopimelate decarboxylase
  Subcellular localization annotation: CTP_CleavageSite=45; ConfidenceScore=5.18e-01
MAASHVLYNPPSLSKTFINHSLNQNPFPQNLILPLKATIKPRVLRVVHSQKIIANPSLHDSDTKTHFRHYFTKSEDGFLYCEGLKVHEIMDSVERTHFYLSSKPEITRNVEAYKDALECLRSIIGYAIKAVMKVMKNKQE

SEQ ID NO: 233326 - protein, 86 aa, Glycine max
  Coding DNA Sequence Number=SeqID_116548
  Pfam annotation: Domain name=Transposase_23; Domain location=2-50; Score=-13.4; E_value=0.034; Accession=PF03017.5; Description =TNP1ENSPM transposase
MFFLGVGGTIHTVAYGDDVLRVCVDTVYDGEAIVPLPTSEIQYVRDTVNSFIGWSRHLVKPLSYNPVEVSWEASQFGLPDIGVTSV

SEQ ID NO: 233327 - protein, 248 aa, Glycine max
  Coding DNA Sequence Number=SeqID_116549
  Gene Ontology: Mol. function=diaminopimelate decarboxylase activity; Biological process=lysine biosynthetic process via diaminopimelate
  Homolog annotation: Hit_ID=Q9LUL0; Match level="QueryCoverage=84%, HitCoverage=47%, E-value=1e-80, Identity=63%"; Hit description =Similarity to diaminopimelate decarboxylase
  Pfam annotation: Domain name=Orn_DAP_Arg_deC; Domain location=72-210; Score=44.7; E_value=3.2e-10; Accession=PF00278.12; Description =Pyridoxal-dependent decarboxylase, C-terminal sheet domain
MFYYGLILMWIHRSTLMLQQGIRTPKFGIRNEKLQWFLDAVKEHPNELKLVGAHCHLGSTITKVDIFRDAAIIMVNYIDQIQAQGFQVDYLNIGGGLGIDYQHSGAVLPTPRDLIDSEDLTSDILSSRNLFDYHIELVSPAPADAEIAKFDVLGPVCESADFFGKDRQLPTPAKFHFAWYSCLVVHDAGAYCMSMASTYNLKMRPPEYWVRNCVFSMADFIGQASLMLRVAFRGICILTTINESGMGY

SEQ ID NO: 233328 - protein, 105 aa, Glycine max
  Coding DNA Sequence Number=SeqID_116550
MDISKDTNIPVILGRPFMLTASCVVDMGKRKLELGFEDQKIDFDLFVEDKPAPEHNVCLQVMEGGQEVLKAFSEELAMCAYRAKRVHPLRMNTHPLVELPVAKRG

SEQ ID NO: 233329 - protein, 136 aa, Glycine max
  Coding DNA Sequence Number=SeqID_116551
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q602G4; Match level="QueryCoverage=91%, HitCoverage=20%, E-value=3e-19, Identity=38%"; Hit description =Sensor protein
  Pfam annotation: Domain name=HATPase_c; Domain location=29-134; Score= 132.0; E_value=1.7e-36; Accession=PF02518.16; Description=Histidine kinase-, DNA gyrase B-, and HSP90-like ATPase
MWLPCCKNRRKQNRSSCHCKRHSRVIVAADQDQMTQVLVNLLMNAIQILPEGGHISLHLGADAQEAHIVVADDGPGVPPAQQSHLFEAFFTQRAGGVGLGLAVVKQIIEAHDGTISYSTSPWQGAQFNLSLPLVTA

SEQ ID NO: 233330 - protein, 199 aa, Glycine max
  Coding DNA Sequence Number=SeqID_116552
  Gene Ontology: Mol. function=transcription factor activity; Biological process=regulation of transcription, DNA-dependent
  Homolog annotation: Hit_ID=Q1GXZ2; Match level="QueryCoverage=99%, HitCoverage=68%, E-value=3e-58, Identity=54%"; Hit description =Transcriptional regulator, LysR family
  Pfam annotation: Domain name=HTH_1; Domain location=4-63; Score=76.4; E_value=9.1e-20; Accession=PF00126.17; Description=Bacterial regulatory helix-turn-helix protein, lysR family
MASIEEMHYFVEVVKHGNFTSAALALGISKQLVSRRIIALEARLGVRLLLRTTRKLSPTETGKVFFQRAQQILQAIHDAELEISNRSDELRGLLKISVPLSYANLRLAPALTAFMQKHPLVEVWLDADNRHVDMVSEGYDMVIRVTDQPEEGMVARKLENAAIRYCCSPDYIARYGIPDSPQARGKHTCMTHRTSEWLL

SEQ ID NO: 233331 - protein, 188 aa, Glycine max
  Coding DNA Sequence Number=SeqID_116553
  Gene Ontology: Cellular component=integral to membrane
  Homolog annotation: Hit_ID=Q1GXZ1; Match level="QueryCoverage=56%, HitCoverage=83%, E-value=8e-24, Identity=53%"; Hit description=DoxX
  Pfam annotation: Domain name=DoxX; Domain location=72-149; Score =59.6; E_value=1e-14; Accession=PF07681.2; Description=DoxX
  Subcellular localization annotation: CTP_CleavageSite=68; ConfidenceScore=5.35e-01
MPVVCIQPDFDQRMFLHKRSQGRGQPETLPVSVGDSLRVVRNSKRTPKRASRAIMRRLTNCLEMPNASAALVKLPCFTTSTNGLGKVANPAGTIAYIQSVGAPLPEVAYAIAVFVELVLGIALLVGFKARWAAAGIAVFTIAAAFLFHNNMADQMQQIMFLKNFTIAGGLLMVVAFGAGAFSVDNRRR

SEQ ID NO: 233332 - protein, 426 aa, Glycine max
  Coding DNA Sequence Number=SeqID_116554
  Homolog annotation: Hit_ID=Q8PFE9; Match level="QueryCoverage=45%, HitCoverage=68%, E-value=1e-66, Identity=67%"; Hit description =Shikimate dehydrogenase
PRLLADAGGRVDHADAATFRQRTRHHADHLALRAAGGEAGGIGLQRGVRLADRVLQGVIKRARSGDGFGHAGKYRGWIRPVIVAWPATFTAAGTLNGPATTPGGGHGPVAGPLRGQIRRAWPGATGQAAGIHHADGLDHRQREMQHAEDGAHARDGAEVATADQPHGQDARRQATQAGQQQQPQADQGAGAGGIARCADHPDQADAQRDQYRQAHADHAQHGHHQRCAVHRSVLAGQHGRALAQRLVDLVGLRAHAMPLQEALGRLFDQHAQAIHGIAAVRRTRPGQEGDGGLAVVQVDGGGHRIDQRQRQLELDVAVAAGRGGIDDQFEVAQITQVFPVAADRAARFAHRVDQFIGAFRRAVDHHQLGDAGIEEGRGDAARGATGTDQQHAAATQVQAMTVGQVTHQADAIGGVAMPAVALAQQR

SEQ ID NO: 233333 - protein, 192 aa, Glycine max
  Coding DNA Sequence Number=SeqID_116555
  Gene Ontology: Mol. function=catalytic activity; Biological process =metabolic process
  Homolog annotation: Hit_ID=Q5QVZ6; Match level="QueryCoverage=56%, HitCoverage=92%, E-value=4e-16, Identity=39%"; Hit description =Uncharacterized conserved protein
MGAAAEPPKAPDCSYDRAAMLAMEPGRFDQDMEGGWRPLADRGCTREAADLLSAYGALSKAEGNVIITWHEGQLRAELGQTAQAIALMERSHKPVNGSDPGYWNAHVDGMVAFLRQDRSALKKARARLVAIPTPTAMAENIKDGRYHFTTEGGQQVQMPWPPNLDVLDGLLRCFGKPYVEAYGPGCRKPEGR

SEQ ID NO: 233334 - protein, 272 aa, Glycine max
  Coding DNA Sequence Number=SeqID_116556
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q8PFF2; Match level="QueryCoverage=99%, HitCoverage=38%, E-value=1e-128, Identity=83%"; Hit description=ATP -dependent helicase
  Pfam annotation: Domain name=Helicase_C; Domain location=129-238; Score=-6.8; E_value=0.07; Accession=PF00271.21; Description=Helicase conserved C-terminal domain
MARWVTATRDGDLVLHGSPVSAAHVLRKLLWDEVDSVVMTSATLTGGGDFQSLAIDNGIPEEAEMVSLSSPFDLPNQAELIVPKFPVTPDDREGHPREVARYLDTELDWAKGSMVLFTSRWKMEKVAGLMSAARRKQVLVQGEMSKTRLIDEHLRRVAAGEGSVLFGLNSFGEGLDLPGEACTTVVITQVPFAVPTDPQTATLSEWFEGRGLNAFNLIAIPHALRTLTQFAGRLIRTSTDTGRVVILDSRLLTRRYGKRIIDALPPFKRVIG

SEQ ID NO: 233335 - protein, 138 aa, Glycine max
  Coding DNA Sequence Number=SeqID_116557
  Gene Ontology: Mol. function=chitin binding; Cellular component =extracellular region; Biological process=chitin metabolic process
  Homolog annotation: Hit_ID=Q86AI8; Match level="QueryCoverage=71%, HitCoverage=32%, E-value=5e-11, Identity=43%"; Hit description =Similar to Homo sapiens (Human). Mucin 2
MSKSCGFGMTGPLDESISCFLIRVDPWVLVPIAFRGLHILAFRGLHVLTLRGLHVLAFRGLHVLANRGLHALTLRGLHVLANRGLHALTLRGLHVLANRGLHALTLKRTTRPRQQRAARPHLQRTTHPRLERAPRPHH

SEQ ID NO: 233336 - protein, 199 aa, Glycine max
  Coding DNA Sequence Number=SeqID_116558
  Subcellular localization annotation: CTP_CleavageSite=43; ConfidenceScore=5.51e-01
MTLSSWQNKLNRQMATPPSSLPPPTEAASHSLSTLKRTRKALSANKDNVDDTVCENMTLARRNGPIFVRAAETPCGRYDVRKNAQAIQKQNTAPHMLSRGGYEYLEKKLMDEKTKKKLEEVAQSESTETVIDPPSPIRRHVKWKMARTKKTSQMTSEVAKEIDEKFDSLEEQASQGSFVPHGRQDVLIAAIGRPEHPGR

SEQ ID NO: 233337 - protein, 57 aa, Glycine max
  Coding DNA Sequence Number=SeqID_116559
MGVLSNTKNMNQLFPAKRQGNHWVWHKKLGHASSSLISKLQRHDLVRGLPRVSYKDD

SEQ ID NO: 233338 - protein, 49 aa, Glycine max
  Coding DNA Sequence Number=SeqID_116560
MPSCQIIVEIYGMEASEVGLDQLLKFERQCVLPQDDAKSFRWQSCAKNQ

SEQ ID NO: 233339 - protein, 103 aa, Glycine max
  Coding DNA Sequence Number=SeqID_116561
MKINVHTSRFLPSENVPRAKVLRFGGMLEFQHTFNIWQYLGFPLLSGKLLSRAGKVTFAKSVLSSMPIYIMHSLCISEVLFGVGRLVFGLNGQQPALQGVEVA

SEQ ID NO: 233340 - protein, 46 aa, Glycine max
  Coding DNA Sequence Number=SeqID_116562
MVDCLLEALSGGLASIVFRHCRGGSLLQLTIGKVVEPTVGPDRVHS

SEQ ID NO: 233341 - protein, 181 aa, Glycine max
  Coding DNA Sequence Number=SeqID_116563
MFVKMFPKKNKAVSILVINNVENAKKAFLKQWFIPRRWVNFRNLKEDGSDVKDFFDYVGWTIFLEKFSTLHYCPYALFWGTKRPDKVSIRGCVNREEVIIFSKSITATSDCFKEALVFDKDWEDITYETVDIMLYERPRPKSVDKKTMLSFLRIECSSHQPLNGGECFYITLGLSRVFMID

SEQ ID NO: 233342 - protein, 177 aa, Glycine max
  Coding DNA Sequence Number=SeqID_116564
  Gene Ontology: Mol. function=DNA binding
  Homolog annotation: Hit_ID=Q9LTA2; Match level="QueryCoverage=98%, HitCoverage=65%, E-value=1e-09, Identity=27%"; Hit description =Similarity to AT-hook DNA-binding protein
  Pfam annotation: Domain name=DUF296; Domain location=5-130; Score =62.4; E_value=1.4e-15; Accession=PF03479.5; Description=Domain of unknown function (DUF296)
MEPSMKVIIVNVTSSSDIIESILDVVHRGHVSLTVLSSSGTIMEVTLHNSSHGAGALPLCGPFTLLSLNGSYLYNNHYTLHPGATLVPPLSFGISFSTSQGQVFGGAIGGRVIAGNDVSLSICTFKNPVMYKYASRDKEKNEGNNNNNNNYNNNSKDFIGSSELLGFNMISCGVRGW

SEQ ID NO: 233343 - protein, 134 aa, Glycine max
  Coding DNA Sequence Number=SeqID_116565
  Gene Ontology: Mol. function=transferase activity; Biological process= DNA integration
  Homolog annotation: Hit_ID=Q1T010; Match level="QueryCoverage=70%, HitCoverage=8%, E-value=2e-20, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
EKKEKLATQLAQASSARRGELGCFLQKAPPTGELPGRPKFNMWGCNPIETPVEVNLKFAKGANEASVDGTLFMSDPRQSHLLAAKRIMRYLKGTLGYGIIFPHQTKEDDNLHLVTYLDSDWCGDLVDRKSTMGQ

SEQ ID NO: 233344 - protein, 56 aa, Glycine max
  Coding DNA Sequence Number=SeqID_116566
MWVEGSTTVHNVPLGNDQVKVGVEEVQNADARVPVPTQEVQLVRQENMELRDWKNL

SEQ ID NO: 233345 - protein, 100 aa, Glycine max
  Coding DNA Sequence Number=SeqID_116567
MKTFIVGEITATLEEAVNDVGGGGDGEVVVVDKGGQVDNGGEERAEDVFVRKIQRKLGLGVDLHKHDRDKAKKTDEVEATAKQPGRQHMRKHTVDEVTHT

SEQ ID NO: 233346 - protein, 89 aa, Glycine max
  Coding DNA Sequence Number=SeqID_116568
MEKAFPSQPDTSHLPCLVDTSGQVFITAVVSPAKPPPKPDDPLYLMTLTIPELFSRPYQVRWDATVFGVFNPDFPLYIKHEDLSEIAHG

SEQ ID NO: 233347 - protein, 373 aa, Glycine max
  Coding DNA Sequence Number=SeqID_116569
  Gene Ontology: Mol. function=transferase activity; Biological process= paclitaxel biosynthetic process
  Homolog annotation: Hit_ID=Q1RZ42; Match level="QueryCoverage=52%, HitCoverage=56%, E-value=2e-39, Identity=44%"; Hit description =Transferase
MVIEGWFPLLEMLKFWMYSLENFESREYDSNYAISTALSVPWGFFMGLLPAKLELTAERVADRETVVRLVEEGVIGMATMSEEGVKILGAVVKREVGGIAEGEEECNDDASDSVEDSAMVGNGARWCGENEGFTTTTTMVASSTTVKEILYLRHHVVIMFRSTRFKISHNSLNTTKLDPAKVIKEVLSKALFYYHPLAGKLVRHADGKLRINCTSHQGIPFIEAICNCNLSSLHYLDVGWSHAVCDGTGVSQFLRAVAEIARGKTEPSLKLVRERERLVGTITIQPMKNPMDNASLAVSPFLLSTDFLDEYYKVDRESIARLKMSLTKESGNEESTEKKGLTNFETLAAYIWRILCPVDITGMPSRKHLLRYT

SEQ ID NO: 233348 - protein, 133 aa, Glycine max
  Coding DNA Sequence Number=SeqID_116570
AHWQLLVLCPGDNVVVWFCSLRKRPDAAIKGAVNSHVQTGNYECGYYVMHWIWCIVTGRLKDDWIHGGGDKDYKEVPPPPLFEPAGGHINQAVTFSRSYYKLAKDFVVSGTASESLYSASEAMFKPDMVGPKD

SEQ ID NO: 233349 - protein, 115 aa, Glycine max
  Coding DNA Sequence Number=SeqID_116571
MDFNDSPVLELTTDYDDHGDNTVVDLIMFYDGCLLQTVIEWPTIQRRLPDSPVVELRKDYDGHGDNTVVDIIGFYDDCLYRTVVDLSQYYYGLLLPTTVVREGLKTTTVLMKHRH

SEQ ID NO: 233350 - protein, 319 aa, Glycine max
  Coding DNA Sequence Number=SeqID_116572
  Gene Ontology: Mol. function=transferase activity; Biological process= paclitaxel biosynthetic process
  Homolog annotation: Hit_ID=Q1RZ42; Match level="QueryCoverage=97%, HitCoverage=66%, E-value=3e-87, Identity=52%"; Hit description =Transferase
  Pfam annotation: Domain name=Transferase; Domain location=1-312; Score=-33.3; E_value=2.4e-09; Accession=PF02458.6; Description =Transferase family
MIFVVVTKFLCGGFTLVVGLSHAVCDGTGASQFLPAVAELASGKTKPSVKPVWERERLVGTITTQPLQYPMGSACVAVSPFLPTTDFSHECSKVDSESTARLKMSLMEESGNEECMTKKKGFTTFETLAAYIWRSRARALKLSYDGETNHQTMLNIVVGVRPHLLDPLPRGYYGNTIVEAYVMLTVREPNVRALLEVVKLIRKSKKVAINSNYIRHPIDSMETPKSVKYNYESGAITILMDWRHLGLLENVDFGWKELVNTMPSPRDIYGSMGLCTILPPSNLDPSTSGGARVYVSLPSSAMPKFKEEMKALTSIKKSS

SEQ ID NO: 233351 - protein, 158 aa, Glycine max
  Coding DNA Sequence Number=SeqID_116573
MKAEWCHKQRIPFKAETVTGKHNGKVTNKAALEATRITVSFLVNKLEGNGNGKENNDNINFPLSVEDTNGVVYELQFLNVGENSSLQVNVVTMMTTKVFNLSGVPTRRRRLGRKTCVLSGLVGLAKSGPKWSRRDALAAMLNLVVVNSLESVPICHKQ

SEQ ID NO: 233352 - protein, 1244 aa, Glycine max
  Coding DNA Sequence Number=SeqID_116574
  Gene Ontology: Mol. function=RNA-directed DNA polymerase activity; Cellular component=nucleus; Biological process=RNA-dependent DNA replication
MGRGRPKKSVSPSPETPNQNTTPKKHNHCEEVNHIVGSSNGSSKGLKNLESIEERPQFENLCEKDGEESKPESEEPRRLWVDVLSNNRNPANGMVIEYVAPKIVNGDIEIDIEEEDIASEMKFWETTLIMYVLGGEVSMHMVKQFMMKTWHFVQLPNMYYHDDGYFLLKFQSNQDMELVLMRGPYTIRNMPMLIREWKPDFNLKQDMLRTLPIWVQLPQLPLHLWGGKSLGKIGSALGTQLVIDESTANKLRVSYARILVEADVTPELRNEITIKDNEGRRITQKVEYEWKPMFCDKCQKFGHKCGEVKPRKQWIPKQKPPEQRIPVVTIVPDKVTPTEPKEKHPDDTLEDWSVVPSTRKDRGKTKQNEGIPPPINCKNGFETLRGSNGPLVIRDCVKKSKAINIRKKLRFKGMYLDNYVDHDNGRIWLCWDNNRIDLKFVHSSSQLVHCGVYSLDGIFRYWLTLIYALNKLENRRILWKDIVTLHSHQQGPWCLIGDYNNVAKAQDRIGGKMVTEAEYTDFSDMLEQTGLAEMHSQGDYFTWSNKHVEGTIYSRIDRLQHRDRVILKKYHFKFINGSVDLDGYNDAVSASWREPITGRPTFVAQLDLSIDLMNSTNIAKVKKYTDELIYFQELEENVLRQKAKIDWLKLGDGNNSFFYATIKSRATAKGMNMLRKIDGTVCATQEDIENLVLEFYGELMGKKSINLKHIDAAAIRRGGQFSMEQRQFLVAPVSDQEILKALNGIGDLKSPGIDGYGAKFFKSSWDTIKDDINNAVVSVKDYRPIAGCTILYKIISKILTTRLGKVLNRIVSPCQAAFVPGQQIHNHILLAYELIRGYARKNGTPRCMIQLNLQKAYDMVDWFALETILLEIGIPKQFVKWIMLTITSVTYRFNINGNYTKCMKANRGIRQGEPLSPMLFIIIMEYLNRLLHKMQRNPDFNHHSKCEKLNITNLAFADDVLLFARGDCRSVEMLMQTLNTFSETTGLVVNPSKCNIYFGGVDAPTKTDIMKLTGFKEGPLPFKYLGVPLTSKKLSISHYLSLIDRITGKFNHWSNKLLSYAGGVDKSRKSPVAWTNVCRPRKYGGLNVIHLQTWNHVTMMKLLWSLSEKADNLWKDRGKFSMKTLYLKMRCEGSNEGPESHDHLFFGCSVLGDVWKQVLKWIQVKHHPQEWNEELKWIIRHGKGKGHKASILKLAVTETVYGIWKYRNAKIFEEIQEYDGNEKVKVMQALNLVQEIEMQRMKES

SEQ ID NO: 233353 - protein, 117 aa, Glycine max
  Coding DNA Sequence Number=SeqID_116575
  Gene Ontology: Mol. function=amidase activity; Cellular component =chloroplast; Biological process=translation
  Homolog annotation: Hit_ID=Q9FY73; Match level="QueryCoverage=95%, HitCoverage=18%, E-value=4e-35, Identity=62%"; Hit description =Putative subunit of TOC complex
MVDFCVLVGTDTTGCVRIPASFCGIFGFRPSHGAVSTIGVLPNAQSLDTIGWFARDPSILHRVGHVLLQLNSVETKRSRHFIFADDLFQLSKIPTQNTIYVIGKAIENMSGCKFLDL

SEQ ID NO: 233354 - protein, 259 aa, Glycine max
  Coding DNA Sequence Number=SeqID_116576
  Gene Ontology: Mol. function=glutathione peroxidase activity; Cellular component=periplasmic space; Biological process=response to oxidative stress
  Homolog annotation: Hit_ID=Q8P365; Match level="QueryCoverage=56%, HitCoverage=90%, E-value=1e-50, Identity=62%"; Hit description =Glutathione peroxidase
  Pfam annotation: Domain name=AhpC-TSA; Domain location=95-237; Score=- 21.6; E_value=0.052; Accession=PF00578.11; Description=AhpCTSA family
  Pfam annotation: Domain name=GSHPx; Domain location=99-190; Score =82.1; E_value=1.7e-21; Accession=PF00255.10; Description=Glutathione peroxidase
  Pfam module annotation: Pfam domain module=AhpC-TSA::GSHPx; Domain location=95-237::99-190
VDSRGSPGGTLQRLGRLQREQCVIPYADAGKTCSHKSDCTGQCLAGPEVAAGSAATAPSPRSAAVASAERGLGSTTARAALCWWAIPRCCRSPRVSTPIQDISLTTIDGQPSSLADYQGKYEGLQALYAEKHAQGLEVLGFPANNFLGQEPGSEAEIQQFCQLTYDVSFPMFSKISVAGDDTHPLYQQLTAAQPQSIGEGPLRERLASKEIPIHAAPAVLWNFEKFLVGRDGKVIARFAPDVAADDARLREAIEAALAA

SEQ ID NO: 233355 - protein, 107 aa, Glycine max
  Coding DNA Sequence Number=SeqID_116577
MVLLLLGSKHNNSAGRRNRSRRQNGTESERRHQNETEDAGVASVQSSNGARVEDDGAPICFKVAARKTAPEPAPLRPAPPRHETALLQRCPSQMGAATTSIDYIGLW

SEQ ID NO: 233356 - protein, 762 aa, Glycine max
  Coding DNA Sequence Number=SeqID_116578
  Homolog annotation: Hit_ID=Q2QLI6; Match level="QueryCoverage=29%, HitCoverage=43%, E-value=9e-60, Identity=56%"; Hit description =Expressed protein
  Pfam annotation: Domain name=Myosin_HC-like; Domain location=640-762; Score=-73.4; E_value=3.5e-05; Accession=PF07058.2; Description=Myosin II heavy chain-like
MGGGPRTYPGGVSKWVWKRMQAKKAKQLMKARLCRERQIYEMRKRAELKAAVSELERPWEVVEREASASAPNLFSIGADEQVKVLADRFQRPGGFDLWSERDGPVLFESPDELPSARFFPKGVVHSVKPYRRVDGYGLVKDADGDGEMGLLKGNDFGGGLRELGDGGLSGLEDVDRLELEDDDDGECSSSDVSYGSDGGLRRNENGGRFLSDDVGRSSNRGRGQGQSSRNYGRNGADGDGRMRKNGNGRRFLSNNVDRSSGGEQSSPLNYGGDGMDGDGRLRRNGNGRRVLSDEDSSDGKRSSHLSYGRNGVDGDGDGGLRRNGRGRRLMSSGDGGQSSRLNYGRNGADGNGRLRRNGNENGRRILSDDDGRSSDGGRSSRVHYGRRNGLNFDGRMRRNENGSKYVVQGVDGADGGESLPHSSSSGRYGASFDGRLRNSGSGRRVLSKDVDGSGDGGLRSKENGRRFMSKNVDGSNGLYSGGASSVRKQRGGNSIGGRSRGKYTNRTSEYASPRGRDANSEVYDMDLQQDGSYGFRKKREQPDSTNELIKVDEKLKAAEALLESKNLEIKKINEEKRAALAAQFAAEATLRRVHAAQKDDEMPPIEAIIAPLEAELKLARMEVAKLQDDNRALDRLTKSKEAALLEAERTVQIALANASLENKILDKILWQKVAEVEKLTQTVRELEEAVLAGGAAANAVRDYQRKVQEMNEERKILEREVARAKVTANRVATVVANEWKDANDKVMPVKQWLEERKFFSGM

SEQ ID NO: 233357 - protein, 55 aa, Glycine max
  Coding DNA Sequence Number=SeqID_116579
MGFGRMRDGYGDEGVGVTERDKIEQNVMCGSGSVGSSAVEKKMDEERRNYETLEC

SEQ ID NO: 233358 - protein, 232 aa, Glycine max
  Coding DNA Sequence Number=SeqID_116580
MVVPSMKKVVFVVVPNTKKFMRVPSVIGVVHLCEIKIHYGLGGMSDLGYGLFEHELGSVGVGSNYVRMRFSTVIHSMGAWDLKYSVTSGIKMWWKGKDVDYDSLEDLVTDQDALDLENYALEHKHEAKIYMVPGYDNDLEYGVNDAFDWDFGLDNGQSSVKQKAKKKVANEDPLEMSGDNEVDPPHVHTHPNFREMYHLETVCKTKECPFQAFVSKVGETSTFQMGETFLTL

SEQ ID NO: 233359 - protein, 313 aa, Glycine max
  Coding DNA Sequence Number=SeqID_116581
MASQEALRQAFWILFGYVSGNMYLEVSKEYRYLTQAPVVLLRILSTGCMLVEIFLYKPEIFQKVRPRCEAPRRDMIYPTNYTPCRYVRISCLRGNPIAIFFVQLIGVPVAGLEPEFQPVVNYLLPSILSHKQDPHDIHLQLLQDMTSRLLVFLPQLETDLSSFPDSPESNLRFLAMLAGPLYPILHVVNESRDAKIKVDEKHNRKYQFKNECVWEEVGVASIDGKAETCFVVVVWSHEKSTHKSQTTSKPPGNITDLDVSKSSQLSPTLTVSTNFEVFKGPINPRSHLPLGLQRSKSAFIKPCLFISETGIYN

SEQ ID NO: 233360 - protein, 121 aa, Glycine max
  Coding DNA Sequence Number=SeqID_116582
  Homolog annotation: Hit_ID=Q108V0; Match level="QueryCoverage=98%, HitCoverage=5%, E-value=6e-18, Identity=44%"; Hit description =Expressed protein
MQKLINPDTEQDVSKPQDEVTSLLEDKSNLELSSSFTLVDYSKLLGEEFQMPDEQWDCSYLNILDMGAVEEGILHVLYSCASQYVHCLTHCSLQPVLCSKLAERSSDFWAAVPLVQALLPG

SEQ ID NO: 233361 - protein, 248 aa, Glycine max
  Coding DNA Sequence Number=SeqID_116583
EKSKLKEDIIARRQKKLLMRHARQKHLEEAALREADLLQELDRERTAEMEKELERQRLLEIERAKTKELRHNLDMEKERQTQRELQREIEQAESGLRPSRRDFPSSTHTSRPRDRFRERENGRSGNEGSTRAGSGSLQSEIPSTSSSMAPLPTIVLSGSRTLSGQLPTILQSRDRQDDTGSMYEENVDGSKDSGDTGSIGDPELVSAFDGQPGGYGSQRHSSRGSKSRQLGERRDRDSRREGKWERKH

SEQ ID NO: 233362 - protein, 102 aa, Glycine max
  Coding DNA Sequence Number=SeqID_116584
MGAGDVSGRMWNGESRSADRLGTLTDADCDDVIIAIVDGSARPWRASAPARSWRRPVGSHSARLGTRTKESDMCASQRASKPVRRKEADWWDPPVGCTADRP

SEQ ID NO: 233363 - protein, 110 aa, Glycine max
  Coding DNA Sequence Number=SeqID_116585
AVLSFAEVLLADSRFTRPDMGFHPTKLNFVPSDADEAPLDVSICLHAFGIVGCDPFHPGLFVGDAGGFQSPTREPLNVGGLVPPHCSLKSVVSDDACPGACFVQRDATTL

SEQ ID NO: 233364 - protein, 44 aa, Glycine max
  Coding DNA Sequence Number=SeqID_116586
MLYGTLTERVLELESMRLQLLPQVPPQKWTRLTHLAHKCTLSAI

SEQ ID NO: 233365 - protein, 132 aa, Glycine max
  Coding DNA Sequence Number=SeqID_116587
  Gene Ontology: Mol. function=protein serine/threonine kinase activity; Cellular component=flagellin-based flagellum; Biological process=protein amino acid phosphorylation
  Homolog annotation: Hit_ID=P28582; Match level="QueryCoverage=74%, HitCoverage=25%, E-value=6e-35, Identity=61%"; Hit description =Calcium-dependent protein kinase
  Pfam annotation: Domain name=Pkinase; Domain location=3-131; Score= -86.2; E_value=0.002; Accession=PF00069.15; Description=Protein kinase domain
MGRCWGVGVGDWGDNTRSCPTSLPCLLTATLTLEDNQSVHVLMELCAGGELFDRIIAKGHYSERATASICSQDDKGLLKAIDFGLSVFIEEVGSAYYVAPEVLHRSHGKEANIWSAGVILYILLSGVPPSWA

SEQ ID NO: 233366 - protein, 79 aa, Glycine max
  Coding DNA Sequence Number=SeqID_116588
MAGGVSVGKRASGLVPKATLNAVEAISANKKSNNNPIVVIDNYDSFTYNLCQELRELGNCRRPKSILFHLWDFFLNDVD

SEQ ID NO: 233367 - protein, 260 aa, Glycine max
  Coding DNA Sequence Number=SeqID_116589
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=69%, HitCoverage=7%, E-value=6e-47, Identity=49%"; Hit description=RNase H, putative
  Pfam annotation: Domain name=G-patch; Domain location=18-62; Score =13.5; E_value=0.0042; Accession=PF01585.13; Description=G-patch domain
  Subcellular localization annotation: CTP_CleavageSite=24; ConfidenceScore=5.08e-01
MSSAYVKSPPVQPHSSSATLIVARVMLGHGCEPGMGLGRNRNGIARLVEFAKNRGRFWLGYEPTRAEKRRIALERKERSSAQPRGLSNNESCESSDTKDPDVDFEKLINQAEKGEDEDWGLPPNLKRMVEQEEREVKPHQEETKVVNLGVDGERKEVKVGTCMSANIQDELVTLLRDYQEIFAWSYQDMPGLSSDIVQHKLHLNPECSPIKQKLRRMKLEMSLKIKEEVKKQFKASFLAVARYPEWVANILPVPKKDGKV

SEQ ID NO: 233368 - protein, 109 aa, Glycine max
  Coding DNA Sequence Number=SeqID_116590
KIGEELATQLAQASSARPSELSSPKRAQLAQASQVASSRSNRLLEEESGRHTQRDCPYPKKEQSGGCLNDQTGHPKATGRVFTLNGAEALKSKDLIQGVSLAIIGGVCS

SEQ ID NO: 233369 - protein, 203 aa, Glycine max
  Coding DNA Sequence Number=SeqID_116591
ASQGSFVAHGRQDVPTAAIRQLEHPSRVRVAGADVMIKQYFGPTSRTSCTSSSMAPEDLEQLTQKIRDQLEESIIEKVGPSAARVSIKESCVDPSGNDPDPGDSDKCGLHVKENPPHLVALGRLYEGSTTVHNIHLLHDQVKVGVEEVRDANAPILIPTEEGAVGSVKLADRADHDVDDHLYLITLTIPQLFLKSLLIMWELS

SEQ ID NO: 233370 - protein, 63 aa, Glycine max
  Coding DNA Sequence Number=SeqID_116592
MAPKKNEIVGIPVINNVEDTKKTFLKDLFIPGKWVDFHSLREEGFDGTARQNGMSIRGTVKRW

SEQ ID NO: 233371 - protein, 181 aa, Glycine max
  Coding DNA Sequence Number=SeqID_116593
KSNDMQRYHMVIRTFCQLEASEPVDTQRLTSSSAPLSSRDGKSDDMRRYLMVIRTFCQLEASEPVDMQRLTSSSAPLSSRDGKSDDMRRYLMMSASFGRDSEKVSFAIRQTQGFASSGRDYEKVSFAIRQTQGSGSILKGPTQGSGSMQRYLRVIHTFHQLEASEPIDTQRPMWSSAPFPE

SEQ ID NO: 233372 - protein, 95 aa, Glycine max
  Coding DNA Sequence Number=SeqID_116594
MRLPGKESLLMKSPITINEILDVSISFLNDHLEETLGSTKIEEIHSKCINLAQDKRDAPHYFHDTNAKMMIWKLHAKLVMHAPMQTLKCQIFMVM

SEQ ID NO: 233373 - protein, 123 aa, Glycine max
  Coding DNA Sequence Number=SeqID_116595
MESTNVKNKSSGKRKMSSEDTRSYFAWNLEMERVLTNVLRDQRNLDNKGDGNWRAVTYSTAAQIFSKHFGVHLMRDNVKNHFKLWRTWYEIASDILIQSGFDWDSTKYMITVENEIAWNEYVK

SEQ ID NO: 233374 - protein, 56 aa, Glycine max
  Coding DNA Sequence Number=SeqID_116596
MSDNRDFFMLKFTRNADDEYQTILYNQRDGSFRTLLWCNFKIFTKTLVISNALSDV

SEQ ID NO: 233375 - protein, 65 aa, Glycine max
  Coding DNA Sequence Number=SeqID_116597
MGGAMTLLDIPGGGNIVFFIRKNTCTWGHVTRFRTPLRLRLIIVEGGGELPVHDRVTSPLTAQFS

SEQ ID NO: 233376 - protein, 50 aa, Glycine max
  Coding DNA Sequence Number=SeqID_116598
MVELVSGMLRWLWDMMFYVPQWRWMNPCTSWMILPFGEVIKDFDRLSVLV

SEQ ID NO: 233377 - protein, 67 aa, Glycine max
  Coding DNA Sequence Number=SeqID_116599
MDKSKEVATPLATNCYLSVDEKGKLSDQTNLWYPKGVEISLVGYSDFDFSGCKLDGKSTSGTCHLLA

SEQ ID NO: 233378 - protein, 171 aa, Glycine max
  Coding DNA Sequence Number=SeqID_116600
MTKKKNKRIKSIRHRTTDPIMKKEKEPAKGGLSVRGKRVAHSPSPPNALKETPWFFEEHYEASNKFSYAKKEMIQPMLVWRGSKFYLHKDTEIISPTLVGCLLISYCMNSSPSIVGTYEGNTPMLKSGSPNMSRPTSTLICCLSSLGLGQGGARLRPKEFSPMPLYGLHPL

SEQ ID NO: 233379 - protein, 289 aa, Glycine max
  Coding DNA Sequence Number=SeqID_116601
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-28, Identity=32%"; Hit description= UPI00006A17C9 related cluster
  Pfam annotation: Domain name=PT; Domain location=6-41; Score=8.4; E _value=0.083; Accession=PF04886.3; Description=PT repeat
EGYTPSPSEHYTSSPSEDCTSSPSKDFTSSPTEGYISQPSEEYTSSPLEGYAPSPSEDYTSSPSEGYTPTPLEDYTSSPSEDYTSSPTEGYMSSPLEGYAPSPSEGYTPSLSEDNTYSLSDDYTSSPTEGYMSSPSEGYVPSPSEGYTPSPGLHTLAFRGLYVLAIRGLHVLAIRELHVLTFIGLHALTFRGLHVLAFRGLHILAIRGPHVLTNRGLHVLTFRGLHVFAIRGLHVLANRGLYVLTFSGLHTLTFRGLRVLTFRGLHALAFRGLRVLAIRGLHALTIRGL

SEQ ID NO: 233380 - protein, 349 aa, Glycine max
  Coding DNA Sequence Number=SeqID_116602
  Homolog annotation: Hit_ID=O80784; Match level="QueryCoverage=78%, HitCoverage=11%, E-value=2e-44, Identity=39%"; Hit description =Nodulin-like protein
MESIEMEEAAFGIDESNDDLCSSILSRFANSTDETHQHLCAVIGAMSQELKDNNQPSTPFAYFCAARVSLDKFTSEPNPPSHVIDALLTILSLALPRVPLELLKKQNSQQGEPFSELLLRVLRSPSSASETALVSGLKCLSRLLIARESVDWSDVSPLFNVLLGFLTDSRPKVRRQSHLCHRDVLLNFQNSSLLASASEGVTNLLERFILLVGGAKANAGEGAKEAQQILYILDALKECLPFLSRKSKTSVLNYFKYLLDLHQPLVTRRITDGLNFLCHYPTSEVSPEALLELLNSLARSIESNKMSGDRLTFTARLLDAGMNKVYSLNRQICVVKLPVVLNALKGKML

SEQ ID NO: 233381 - protein, 205 aa, Glycine max
  Coding DNA Sequence Number=SeqID_116603
  Gene Ontology: Mol. function=enzyme inhibitor activity; Cellular component=cell wall; Biological process=cell wall modification
  Homolog annotation: Hit_ID=Q1SGV1; Match level="QueryCoverage=84%, HitCoverage=82%, E-value=6e-50, Identity=60%"; Hit description =Pectinesterase inhibitor
  Pfam annotation: Domain name=PMEI; Domain location=26-186; Score =148.7; E_value=1.5e-41; Accession=PF04043.6; Description=Plant invertasepectin methylesterase inhibitor
  Subcellular localization annotation: CTP_CleavageSite=35; ConfidenceScore=5.45e-01
MQTQRVNTLALFLLLLLSPPRPAASMPPRDPLRSSCAKARYPTLCFQTLSNFSNLATKPLDLAQAAIKVSLARTRTLSVYFKTLNATSSRFGKRQRVAVSDCVEQISDSVTQLINTLNELQHLRAGTFQWQMSNAQTWTSAALTNGDTCLSGFNDGGATADGAKIKLEVKRRITDVAMLTSNALYLINRLGDDSVSGKPRTDFGN

SEQ ID NO: 233382 - protein, 618 aa, Glycine max
  Coding DNA Sequence Number=SeqID_116604
  Gene Ontology: Mol. function=binding; Cellular component=integral to membrane; Biological process=regulation of transcription, DNA -dependent
  Homolog annotation: Hit_ID=O80784; Match level="QueryCoverage=95%, HitCoverage=23%, E-value=1e-141, Identity=48%"; Hit description =Nodulin-like protein
  Pfam annotation: Domain name=NUC173; Domain location=1-154; Score =124.9; E_value=2.3e-34; Accession=PF08161.2; Description=NUC173 domain
MEDVQKLPDEDFPFRKQLHECFGSALVAMGPEILLSLIPLNLEAEDSSDANVWLFPILKHYIVGAPLNYFTEEILTMIKRVREKAQKLEKQGLMVSSRNADALAYSLWSLLPSFCNYPSDTAQNFMNLEKHLRSKLKEEPDICGIICTSLQLLIQQNNIVDSKDKGYMGEDMSKEQILVHYSQQVARDNLYVLKLSARHWLKDLSEVFLKSSKDDGGCLQRTIGDVASIADKVDVRNLFKEKMLKLYKCTRKASKVGSSKNSHSMQIDDASNNLSPSILRAQLLDLAVSLLPGLDAEDIALLFEAIKPALQDAEGVMQKKAYKVLSIILRSSSNDFVSSKFEELRQTMVEVLPCHFSAKRHRLDCLYFLIVHVSKSKADMEHWRDIFLTEIILALKEANKKTRNRAYDILVEIARAFVDEERGGNRESLNNFFQMVAGHFTGETPHLISAAAKGLARLAYEFSDLVLTAFKLLPGTLTLLRSDNKEIIKANLGFLKVLVAKSQAEGLQMHLKSMVEGLLKWQDNSRNHFKAKVKLLLGMLVTKCGLEAVKAVMPEEHMKLLSNIRKIKERKERNRSAKSEETRSHFSKATTSSGADQGCPKPLSRIVGWSLYGNLEAN

SEQ ID NO: 233383 - protein, 208 aa, Glycine max
  Coding DNA Sequence Number=SeqID_116605
  Homolog annotation: Hit_ID=Q09JM0; Match level="QueryCoverage=34%, HitCoverage=95%, E-value=5e-10, Identity=42%"; Hit description=10 kDa putative secreted protein
DGAAALLSRAMESRAPSGPFLVSRNWRCGMNRKLGYGAQLRANLDPTKGVGRLRQQGRWSWKSKSAKECVTTHLPNQLAPKMDGAKARDLYPAGASPGGAVVGADLGGSSKYSNENFEGRRGERFHVNGTCTWPAHPGNGSAGGRVQRLEEHRTSRASGRWNNVGKGSRQNGSVTSGKGLALRAGHGAPSPEPVGCRWTARAASAARA

SEQ ID NO: 233384 - protein, 118 aa, Glycine max
  Coding DNA Sequence Number=SeqID_116606
MVRTKKIGQMTSKEAKEIAEKIASQGSFVTHGRQDVLTPRTSRTSSSMAPEDLEQLTQQIRDQLEESIIEKPEVGPSTARVSTKESCVNPSGNDPDTVKVGVEEVRDAHSPIPVPTKE

SEQ ID NO: 233385 - protein, 236 aa, Glycine max
  Coding DNA Sequence Number=SeqID_116607
  Gene Ontology: Mol. function=hydrolase activity; Biological process =aromatic compound metabolic process
  Homolog annotation: Hit_ID=Q3KE08; Match level="QueryCoverage=85%, HitCoverage=57%, E-value=4e-77, Identity=67%"; Hit description =Alpha/beta hydrolase fold precursor
MKTLLRQTLLATLVITAAGTAFAATPASHDYAADFSHVQQINAGVLNTGYVDIGPRDGQAVILLHGWPYDIQSYAQVAPALAAKGYRVIVPYLRGFGSTRFLSDKTPRNGQPSAMAADVVALMDALNIKQAVLGGFDWGARTADIVAALWPERVKSLVSVSGYLISSQQLGKKPLPPEAEQQWWYQFYFATERGQQGYAAHTHDFAKLIWQQASPGWKFSDATFNQSAKALDNPDQ

SEQ ID NO: 233386 - protein, 80 aa, Glycine max
  Coding DNA Sequence Number=SeqID_116608
RAFAKRDTQWLSTRKNLEEDELSGSLSAPLQVIKRTASAHPLSEGDILTACMFAILHLVLLYVVKEVSGLWKAKSSIGSS

SEQ ID NO: 233387 - protein, 62 aa, Glycine max
  Coding DNA Sequence Number=SeqID_116609
MNALLEPKLLHPRKTMNCLQPSLITSLESPLDSNYEKIKNKKVAVAGVSLSEAYALSEQHPL

SEQ ID NO: 233388 - protein, 108 aa, Glycine max
  Coding DNA Sequence Number=SeqID_116610
  Homolog annotation: Hit_ID=Q6CQF3; Match level="QueryCoverage=53%, HitCoverage=61%, E-value=8e-09, Identity=73%"; Hit description =Kluyveromyces lactis strain NRRL Y-1140 chromosome D of strain NRRL Y- 1140 of Kluyveromyces lactis
MCASHGRVTRKAQGKLICGDPPVGCTADRPLIFCERVRVGRCGCSVEPRHGIESSKWAIFGKQNWRCGMNRKLGYGAQLRANLDPTKGVGRLRQQDGGHGSRNPLRSV

SEQ ID NO: 233389 - protein, 360 aa, Glycine max
  Coding DNA Sequence Number=SeqID_116611
  Gene Ontology: Mol. function=protein binding; Cellular component =integral to membrane; Biological process=xylan catabolic process
  Homolog annotation: Hit_ID=Q6JN46; Match level="QueryCoverage=98%, HitCoverage=81%, E-value=3e-58, Identity=29%"; Hit description=EIX receptor 2
  Pfam annotation: Domain name=LRR_1; Domain location=128-150; Score =6.8; E_value=15; Accession=PF00560.23; Description=Leucine Rich Repeat
  Pfam annotation: Domain name=LRR_1; Domain location=152-174; Score =5.0; E_value=33; Accession=PF00560.23; Description=Leucine Rich Repeat
  Pfam annotation: Domain name=LRR_1; Domain location=176-198; Score =15.3; E_value=0.22; Accession=PF00560.23; Description=Leucine Rich Repeat
  Pfam annotation: Domain name=LRR_1; Domain location=246-268; Score =4.6; E_value=40; Accession=PF00560.23; Description=Leucine Rich Repeat
  Pfam annotation: Domain name=LRR_1; Domain location=270-292; Score =14.4; E_value=0.43; Accession=PF00560.23; Description=Leucine Rich Repeat
  Pfam annotation: Domain name=LRR_1; Domain location=294-316; Score =14.3; E_value=0.45; Accession=PF00560.23; Description=Leucine Rich Repeat
  Pfam annotation: Domain name=LRR_1; Domain location=318-345; Score =9.6; E_value=4.6; Accession=PF00560.23; Description=Leucine Rich Repeat
  Pfam annotation: Domain name=LRR_1; Domain location=57-76; Score =10.6; E_value=3; Accession=PF00560.23; Description=Leucine Rich Repeat
  Pfam annotation: Domain name=LRR_1; Domain location=85-106; Score =5.3; E_value=29; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=128-150::152 -174::176-198::246-268::270-292::294-316::318-345::57-76::85-106
  Subcellular localization annotation: CTP_CleavageSite=76; ConfidenceScore=5.06e-01
ELRLSWTNLFLSVNSGWVPPFQLEYVLLSSFGIGPNFPEWLKRQSSVKGTLPSVSANVKVLNVANNSISGTISPFLCGTENATDKLSVLDFSNNVLYGDLGHCWVHWQALTTTAFSGYIPSTLQNCSTMKFIDMGNNQLSDAIPDWMWEMQYLMVLRLRSNNFNGSITQKICQLSSLIVLDLGNNSLSGSIPNCLDDMKTMAGEDDFFANPLSYSYSSDFSYNHYKETLVLVPKGDELEYRDNLILVRMIDLLSNKLSGAIPSEISKLSALRFLNLSRNHLSGGIPNDMGKMKLLESLDLSLNNISGQIPQSLSDLSFLSVLNLSYNNLSGRILTSPPLQSFEELSYTGNLALCGPRGIL

SEQ ID NO: 233390 - protein, 109 aa, Glycine max
  Coding DNA Sequence Number=SeqID_116612
MGQVGRKDKELRGRSNGVIGGYHKWFKPRTQGITWLQKLKGLNREESEEVQALKAELKKTRVENEKLKVAVTRVRKECDKLKDINMTVAEALEWETKKDRKEEWSKNKF

SEQ ID NO: 233391 - protein, 162 aa, Glycine max
  Coding DNA Sequence Number=SeqID_116613
MTYTKDKSIVPGDQRFLSPYLYHPTINIVVALGFATSSANKEIIAYTVPSQVEEVESLKKKVVEFVEDLQSTINSNTKLTTEVNTLKSQVQLFENKELGWEAKVKKAKNSVGLLEKELEKLNKVLNDVEQARNFERVAKVKVEKLVELAKMSVIKKHRVIKK

SEQ ID NO: 233392 - protein, 203 aa, Glycine max
  Coding DNA Sequence Number=SeqID_116614
MAKGKAKDVINAKRVVSSFEASSNNHVDGRLAKFIWIRKAKRIKSSSLNLEENEIKLLWVLDIKKILFSVYQTSFWNLHVTLLFGKFTKGVFRILNIAPTRLYPNSWELLKPFKFYSSYYVPTLGFLLFASLLYSSWGEVGWLSMVSRMNAPMLTPYATSYKNFKTSFFKVLVVANGRNHMFTNDSIMMTMDDPFDYQTLSRA

SEQ ID NO: 233393 - protein, 132 aa, Glycine max
  Coding DNA Sequence Number=SeqID_116615
  Gene Ontology: Mol. function=DNA binding; Cellular component =intracellular; Biological process=DNA integration
MNRTLLERARCMLSNSRLNRSFWAEVVSIICYLVNRSPSTPIDFKAPIEVWSNKPTKYSMLKLFGCLVYYHISEVATLDMELEQLDVKITFLPRRLKKDILMQQPEGFKVVGKKNFVCRLKRSLYGLKQPSR

SEQ ID NO: 233394 - protein, 76 aa, Glycine max
  Coding DNA Sequence Number=SeqID_116616
MTLIRGDMGVTCFKILVSRRGSRFRESDMRGKGLIGKVLSGVVIGAIAILGVVVQPTMLPTKKVVCMEKIVVDAVN

SEQ ID NO: 233395 - protein, 220 aa, Glycine max
  Coding DNA Sequence Number=SeqID_116617
  Gene Ontology: Mol. function=nucleic acid binding; Biological process= DNA integration
MREVMPLMEHLDELNFVLMELCDINDRRRRKKKVARRAKLILRTSIITTNNQVTRSEIVQQKHWFMTCEKKSGGNVLMGNEAPCMFIGMGSIQIRMHDGVVRKLIEVYHIPELKKNLVSMGAMDSKDFSCRQGLPGNHNVEPLQFCEHYVFRKQHQTKFPKVMHITKTMLDYVHFDHWGPSRVQSLGGARYFLSITDDYSRMTWVFMKKKKSKAFNFFKP

SEQ ID NO: 233396 - protein, 97 aa, Glycine max
  Coding DNA Sequence Number=SeqID_116618
MVWSLQSPFLLLHSIVIDLQEAKDSIDEEDPRPTSFTWSYISGGKARRKLDASSSPTSSSDAPYWFYGSPNTGSKRHKSSIVSDGSLLEKLLWRLAL

SEQ ID NO: 233397 - protein, 212 aa, Glycine max
  Coding DNA Sequence Number=SeqID_116619
SIDIAIVKEFYANLYDPEDKSPKFALLRPDPQELATKLCIPGRGFELNVDGQPLKILRKNMTTLAQTWSVFSFSNLIPTSHTFDVTLNRAKLIYGIIMKMDMNLGYLISHQISLIAQHDTSRLGFPALIITLYKARGVQSDSRSLENLSPAINLAYIKKNCWNLDDPIVTFRGTRKARGRRSEVPTIQQHQRHQLLLLPQLQYLPFRLQLFL

SEQ ID NO: 233398 - protein, 78 aa, Glycine max
  Coding DNA Sequence Number=SeqID_116620
MDVEEDAEIPLILGRPFILTATCVVDIGNVNLEMSVVDQKTTFSLFEVRTRATPDIPPTAPLPDVSLLPTGQTSLSSS

SEQ ID NO: 233399 - protein, 265 aa, Glycine max
  Coding DNA Sequence Number=SeqID_116621
  Gene Ontology: Mol. function=heat shock protein binding; Cellular component=cellular_component; Biological process=protein folding
  Homolog annotation: Hit_ID=O04087; Match level="QueryCoverage=72%, HitCoverage=42%, E-value=5e-38, Identity=41%"; Hit description=DnaJ isolog; 47062-48761
  Pfam annotation: Domain name=DnaJ_C; Domain location=111-245; Score =2.1; E_value=1.2e-06; Accession=PF01556.9; Description=DnaJ C terminal region
MQKPITPLRFEENDNKRVDEDIWSPKFLSKAASRRSKTPTLKSRPMSRHGSRRCTTPNSLSISSYSSGRRSATKIAASSLKRIMSRNGSLASLPKNEILKIEMKQGWGKGRKITFEGVGDEKPGYLPVDIVFLIDEIKQPLFRREGNDLEICVQIPLVDALIGCSISIPLLGGENMGLSFENNVIYPGYEKVIKGQGMPNPKNNGIKGDLHVQFFIEFPIVVCRCTNLPQNKIEDKERMDFVHLSFHMGEVRAVEKERELPSVLH

SEQ ID NO: 233400 - protein, 67 aa, Glycine max
  Coding DNA Sequence Number=SeqID_116622
MKKLKATMSPSPSEKGLLASCKTLRHVKQVHAQILGLKLDNSNISSKTLIIWFEASSVPIFIVGDCY

SEQ ID NO: 233401 - protein, 154 aa, Glycine max
  Coding DNA Sequence Number=SeqID_116623
MDPKRIKVIPEWPTPSSVEKRIPEFQEPLDLRSNPFLGIKINRERSKGISGLSQETYINKVLERFNIKECSPSVAPIVKGDRLEFGQCLKNDLERENFLESFPSDRSSWSCQTPFSVLSPMLCIRLQHYLHCGEKMMDRSYEIQITLCIEGSEA

SEQ ID NO: 233402 - protein, 409 aa, Glycine max
  Coding DNA Sequence Number=SeqID_116624
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=98%, HitCoverage=89%, E-value=0.0, Identity=90%"; Hit description =Ribulose bisphosphate carboxylase large chain precursor
  Pfam annotation: Domain name=RuBisCO_large; Domain location=161-409; Score=573.4; E_value=2.2e-169; Accession=PF00016.10; Description =Ribulose bisphosphate carboxylase large chain, catalytic domain
  Pfam annotation: Domain name=RuBisCO_large_N; Domain location=28-153; Score=291.3; E_value=1.8e-84; Accession=PF02788.6; Description =Ribulose bisphosphate carboxylase large chain, N-terminal domain
  Pfam module annotation: Pfam domain module=RuBisCO_large::RuBisCO _large_N; Domain location=161-409::28-153
MSCREGFMSPQTETKASVGFKAGVKDYKLTYYTPDYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDDHVNSQPFMRWRDRFLFCAEAIFKSQAETGEIKGIYLNATAGTCEEMMKRAVFARELGVPIVMHDYLTGGFTANTSLAHYCRDNGLLLHIHRAMHAVIDRQKNHGMHFRVLAKALRLSGGDHVHAGTVVDRSRGIYFTQDWVSLPGVLPVASGGIHVWHMPALTEIFGDDSVLQFGGGTLGHPWGNAPGAVANRVALEA

SEQ ID NO: 233403 - protein, 90 aa, Glycine max
  Coding DNA Sequence Number=SeqID_116625
  Homolog annotation: Hit_ID=Q1RWU1; Match level="QueryCoverage=82%, HitCoverage=20%, E-value=2e-15, Identity=47%"; Hit description =Resistance-like protein HAAS-2-related
CTVFTNKSITRVHVVFLDAFRDLSQTGSYAWGATALVHMYENLNDALKRSARQLAGYITLLQCWIYEHFPTVASSIVAEDYHERKSRACC

SEQ ID NO: 233404 - protein, 317 aa, Glycine max
  Coding DNA Sequence Number=SeqID_116626
MVRTRGLHWVLGKVLGRALGKQALVAITEDVENVGNVADEVHEEPHNLVSDHIGADTKSFLGGPQDTSEHTELKLPSHRRKVEKFGRPALEIEGIVTPTGLSSLITCLLETGDRGLLSASAERVPHINVAFLEAFRDLGQSGGYSWGAIALVFILGSTSISLELRSLLLMRITIRGNHVLVIGNLERHYQWGSSTAKHLPKRVVWQFGYVQTIPPLPTAPSLSTEETVDKWLQFFRIPCTTMPQPPALAAIDADMPRHIVATCQRIAKSLEHMINMRMVTTGTDAYTLTEHCLRLARDKGGIHRTEMMVDDDEDGCN

SEQ ID NO: 233405 - protein, 190 aa, Glycine max
  Coding DNA Sequence Number=SeqID_116627
MDMNLGYLISHQISIIAQHNSSRLGFPALITALCKSRGVTSDSRSLESLSPTINMAYIKKNCWNLDDPLITFRGPRKAKGKRSEAPPSSDIPPSTTLSTTVPSSSTVAPSVPAPVPAPAPPTGPSSFPSETLFAMLQSLHRGQLRGQPSPSRGGEAPATQEPVPAEEPMPDVEDEPVPPEPFIFEIDPVA

SEQ ID NO: 233406 - protein, 147 aa, Glycine max
  Coding DNA Sequence Number=SeqID_116628
  Subcellular localization annotation: CTP_CleavageSite=74; ConfidenceScore=5.41e-01
MASLQQFPSLGSSHGKGISMSCLIAVLFFYTLLLKKFTQTLTLRLSPLLFNCMILYFLTPMFNYFRRSLPKPSFAQAFKGHAFAKNESHKWSLIGDFFYKKPSRWKPHRFHMTPGSPLTISSNFKDSGDEFLRKFDEEAAKQKGRKM

SEQ ID NO: 233407 - protein, 169 aa, Glycine max
  Coding DNA Sequence Number=SeqID_116629
MTAKETNKKAAEEATTFVVDGEPVPEEVIIDEDDVKRLEAIYEPLTYDNISNVQEGLEHRKVIQVTAEPIRLSPIFATLDRHLTRMLSFGMENMKQGLEKRIGYWDSGFPGIDPSFYPILDNLPEEEQPALSVYDVDGPAIHMLPPRQTATPNPNNIIYIYEPSTMCIL

SEQ ID NO: 233408 - protein, 78 aa, Glycine max
  Coding DNA Sequence Number=SeqID_116630
MGEELATQLAQASSARPGELSCLLQNIFGMCQLSYFLAPTPTQLHTTFLLELLVVLQLFIGLLLCFLDMLLIITVWGD

SEQ ID NO: 233409 - protein, 608 aa, Glycine max
  Coding DNA Sequence Number=SeqID_116631
  Gene Ontology: Mol. function=carbonate dehydratase activity; Biological process=one-carbon compound metabolic process
NDKWVGITLYYNNGIGSLSAEQIQRISARLRQYGKIEGKNTPTNPSAALKLDLVDPIHTTKYCNISSIAGISSASSFVEMVIVGRMRNYGYGSMPMEKSFRKQQEESEARPKRKKAIPIYLEDYNILDAVRIFAVRELILLGLLGHASWSSKTKCNIGCFHCTTMVDATRSKASADRLEDAIVKLTASQLSMNSKIDDLLHRMSQLEANQQPPQTPPSSSIMQFFKYHSTPNQECLTIASFYMEGSSLAWFQWMHRNAQLSSWSAILYALHSRFASSTYKDSTCSLCKLQQCSSVSAYLSEFESLANRIVGLPAPFVLSYFISGLSLAIRQEVQVLQPISLAQAVAYARLQEENLLDARRPPTHRFQPATATTIATQSTSVNPTPPLLPTPQRTSAPSIPFKSFTLEELAVHREKRLCFHCDEKFSQGHKYSPSLLRARIGGHSALETLHMKGLIDKHHEIAPLRITVGSEDEIRCHQLCTAWLKTLGPMLTDYTSLNMKFITSDKLVKLHGDCEKDVEPDCSISAGDSSGHVGINHNLGWVGVDPYNSSTHANFFDKIRPSDQETLEEEAENIGATKILACVHVHLRSNSVLGRTSVPVGLAKANWF

SEQ ID NO: 233410 - protein, 92 aa, Glycine max
  Coding DNA Sequence Number=SeqID_116632
IALAGHPVDPKKSNRVLELPALITGLYQFYGVPIVPSKVGAGQDTTAACEWPTAGHRRTAATSSSPQLIHKKVRAFPMTHGRPIGDQVQSQR

SEQ ID NO: 233411 - protein, 195 aa, Glycine max
  Coding DNA Sequence Number=SeqID_116633
  Gene Ontology: Mol. function=cytochrome-c oxidase activity; Cellular component=integral to membrane; Biological process=electron transport
  Homolog annotation: Hit_ID=Q4UPS8; Match level="QueryCoverage=74%, HitCoverage=43%, E-value=1e-52, Identity=68%"; Hit description =Cytochrome C oxidase subunit II
MRGSGWHPAAGRWRWGVSSRRPNVRRLQRHLKACSPPAMAATDDAKGLGNEAKQQVGHEVRERGCRSAGDRGTDAVVGLGPGGRSQAVAAEHGQGGDPDLAPGLGIEQPVVDHLHGDRRHRVRGDGLRHVQVPQIQGRGRRHLQPQHQGRGDLDGDPGDHPDRDGLAGHGQPDQDVRHPRCRDDGEGHRLPVDVE

SEQ ID NO: 233412 - protein, 242 aa, Glycine max
  Coding DNA Sequence Number=SeqID_116634
MAEQLPHLAQSLRQSDALRVADSGRRHQQAPGPGLRVPRVGLASGQGRAPLAQVHRRLQQLAGITVPGGLPAGEAQYGSQCHRPEEHGKQQHQGPAAGAARLRGRSSVHAGHFLMVGYGMPVGPRRASCAIPAPAPPPARSGPGRTTARRSPGDAAVAACSATGPDHVRRRRAAPGPGAVHDREVTAPPARGPGLRPAIGWPASGPLPPWRRMRDRVPIRPTAAAPATHVRPPAKGCRHIRQ

SEQ ID NO: 233413 - protein, 186 aa, Glycine max
  Coding DNA Sequence Number=SeqID_116635
  Gene Ontology: Mol. function=RNA-directed DNA polymerase activity; Biological process=RNA-dependent DNA replication
  Homolog annotation: Hit_ID=Q1S4Z4; Match level="QueryCoverage=90%, HitCoverage=37%, E-value=9e-18, Identity=45%"; Hit description=RNA -directed DNA polymerase
MFEVDQVKVVIWECDEKGSNASFIAFVPKKEVPNHLGDYRPISLIGSLYNIIAKVLSLRLKPLLSKIIDETQSAFVGGRKILDTMVVVNEAIHEAKLRGCEGRGCGERGGLKVNFHKSSLGVVNVQRYSLDRFVEVLNCGILTILLTYLGALVGINARKKDTWRIVIQKMQRKLTPWRLRHLSIGG

SEQ ID NO: 233414 - protein, 128 aa, Glycine max
  Coding DNA Sequence Number=SeqID_116636
  Gene Ontology: Mol. function=transporter activity; Cellular component= membrane; Biological process=oligopeptide transport
  Homolog annotation: Hit_ID=Q1RXN7; Match level="QueryCoverage=99%, HitCoverage=24%, E-value=2e-42, Identity=63%"; Hit description=TGF -beta receptor, type I/II extracellular region
MAIGAEGTNPNISTFGADQFDDFNPNEKELKALFFNWWMFISFLGASIATLGLGAFKRIWGGDLGTPIYHHKVSTTKTPAWDIISVPIAAFRIRKLQLPSNPSDLYEHNLQHYVNSGKRQVYPTPTLR

SEQ ID NO: 233415 - protein, 118 aa, Glycine max
  Coding DNA Sequence Number=SeqID_116637
  Homolog annotation: Hit_ID=Q9S834; Match level="QueryCoverage=24%, HitCoverage=9%, E-value=2e-07, Identity=86%"; Hit description=ATP -dependent Clp protease subunit ClpP
  Subcellular localization annotation: CTP_CleavageSite=22; ConfidenceScore=5.41e-01
MVNAPCLRCSSLALHSSMHTSSSSHSQSLSLSSLTCHLSWDDLRVPSSLYFPAYAQGHGPPPTVQERFQGNRYSLPNSRIMIHQQLSGGQGGQTDIDIQKMDQIGPQQYLSSDVFNQK

SEQ ID NO: 233416 - protein, 64 aa, Glycine max
  Coding DNA Sequence Number=SeqID_116638
MAMVLSQIKLELENHHAQICTLGAVAIEIKKNRDYCSRRKEEKLMNKKAKKLSKMIKTSFCLIH

SEQ ID NO: 233417 - protein, 74 aa, Glycine max
  Coding DNA Sequence Number=SeqID_116639
  Subcellular localization annotation: CTP_CleavageSite=60; ConfidenceScore=5.33e-01
MSKNEKNFTYLTNNNLRRTRYRKPRPRKCGIPRQRARRQRLGKRKATRRKATTKGNKKVMAEATNVLLRLLTAR

SEQ ID NO: 233418 - protein, 60 aa, Glycine max
  Coding DNA Sequence Number=SeqID_116640
MERNQMQLSKAKECQTWLHDSTCAYEGTEQAADQQCTVGDVAADQQPSNFPLSAEVSPIR

SEQ ID NO: 233419 - protein, 239 aa, Glycine max
  Coding DNA Sequence Number=SeqID_116641
  Gene Ontology: Mol. function=arylamine N-acetyltransferase activity; Cellular component=plasma membrane; Biological process=metabolic process
  Homolog annotation: Hit_ID=Q3VKF8; Match level="QueryCoverage=86%, HitCoverage=81%, E-value=1e-70, Identity=62%"; Hit description=N -acetyltransferase
  Pfam annotation: Domain name=Acetyltransf_2; Domain location=6-239; Score=242.2; E_value=1.1e-69; Accession=PF00797.8; Description=N -acetyltransferase
GVPAKDIATLNALMRCQLFSVPFENLDVQAGKVVSITPEDIVEKIVYQHRGGYCYEVNGVFAMALQALGFDYQLVAARPMFYPVRRPKTHMAIVVHINQQDWLCDLGFGSYGIRAPMSLEVLDSEVMQDHDCFMLTATDPDAFLLKAKVDQAWQPQFAFDLTPWELIDFYPANYMNSTHPDAIFVQKLLVVLHTQAGRHILFGNTLKTIADGVVEKRILSAAKRTDTLKTLFGLSLEHF

SEQ ID NO: 233420 - protein, 90 aa, Glycine max
  Coding DNA Sequence Number=SeqID_116642
MEEKMTEGEQALVTNCGCHAKLLRIVLVATSMLLHVELASIGSSSSMESFASRRSMEVEWRRKKDDWRCHFKEKMSQEQAHHHRKPWIRA

SEQ ID NO: 233421 - protein, 60 aa, Glycine max
  Coding DNA Sequence Number=SeqID_116643
MSTPRYQQKGKQGKGSQELPRLLAKAKAMADIYSAPEEIHGLLSYCQHMIDLMDHMIRNR

SEQ ID NO: 233422 - protein, 196 aa, Glycine max
  Coding DNA Sequence Number=SeqID_116644
MTLTIPQLFLKPLHVLCDATVFGVYNDNFSLYMKHEDLSEITHDGQCMSIFVIPLWIFALKGFVDSQQSKSKPAARWIVVKCNKKKGSTECKYYVMYWMSMLILGSFKNNWEMVIFYFKRPAVHVVVENEHTQPLLINSKAKEQDEDREEENDNAEETKKHVTSIVVAYKLFTPSVKVRNPSIWRKIEIKQFNNLK

SEQ ID NO: 233423 - protein, 92 aa, Glycine max
  Coding DNA Sequence Number=SeqID_116645
MWVEVCSSVAHVSIKETCVNSSGKDPEMDDSEKCGLYVDDNPPQLVVFGRVHEGSMTVHNVPLGNDQVKEKHGVEGPKKLVDRLILMSIPYT

SEQ ID NO: 233424 - protein, 94 aa, Glycine max
  Coding DNA Sequence Number=SeqID_116646
  Subcellular localization annotation: CTP_CleavageSite=76; ConfidenceScore=5.83e-01
MVPRQPSPFSASTKSPPMPPLLPKVTNLSSSSAKPPSPVETKPPPPTAETTPPSLPMAASHLLVNKHQTLSFDPLLAANLRSHFHRGSYHSRSS

SEQ ID NO: 233425 - protein, 47 aa, Glycine max
  Coding DNA Sequence Number=SeqID_116647
MEMPIGMSALVILTSFVNVNVQVHEIMCRKLSFWKEIVHTHLEICSS

SEQ ID NO: 233426 - protein, 136 aa, Glycine max
  Coding DNA Sequence Number=SeqID_116648
NDNCHKWDRRLAAKRGSKESVWCLLTRRWEAAMGREGGVVSAVGGGGLVSTGDGGLAEEEDGLVTLGSRGGMGGDFVEAENGEGCLGTMVFNIRRMTSSLEAMEVWAIASLAMAASRRSTQAAESLVSAIEEQTKW

SEQ ID NO: 233427 - protein, 193 aa, Glycine max
  Coding DNA Sequence Number=SeqID_116649
  Gene Ontology: Mol. function=thiamin pyrophosphate binding; Biological process=menaquinone biosynthetic process
  Homolog annotation: Hit_ID=Q15KI9; Match level="QueryCoverage=51%, HitCoverage=5%, E-value=7e-34, Identity=68%"; Hit description =Chloroplast Phyllo
MEQEGGLCDGKEVDQFHQPSGSNEVAIANEDGISYGSELIEVDKMVLSGIFFGDRMSLSCRNIWKNFREFRYVHCCRLKQLDHANELSNSLKESANINTVWASLIVEECTRLGLMYLCIAPGSRPSPVAVAVASHKLITCISCFDERSLAYHAVGYGRGSHIPAVAITSSGTAVSNLLPAGDQNCGLSIIGDQ

SEQ ID NO: 233428 - protein, 39 aa, Glycine max
  Coding DNA Sequence Number=SeqID_116650
SDVNGRRKSLQLTTHKNEWGRSISMDVKDVEEYYQECNA

SEQ ID NO: 233429 - protein, 57 aa, Glycine max
  Coding DNA Sequence Number=SeqID_116651
MDKEYNVIVLGMGLKECIHVASIQDAKDRFSQIDSNVTPTRRPSFYYTPRRGETPCY

SEQ ID NO: 233430 - protein, 45 aa, Glycine max
  Coding DNA Sequence Number=SeqID_116652
MPQHYVLHRFLIIDVDTVTSKNAFAEIVHEPSGKLVNGLKKVYQS

SEQ ID NO: 233431 - protein, 194 aa, Glycine max
  Coding DNA Sequence Number=SeqID_116653
  Gene Ontology: Mol. function=DNA binding; Cellular component =chromatin; Biological process=chromosome organization and biogenesis (sensu Eukaryota)
  Homolog annotation: Hit_ID=Q6K709; Match level="QueryCoverage=78%, HitCoverage=54%, E-value=5e-16, Identity=33%"; Hit description=DNA -binding protein-like
  Pfam annotation: Domain name=DUF296; Domain location=53-177; Score =21.5; E_value=7.9e-06; Accession=PF03479.5; Description=Domain of unknown function (DUF296)
  Subcellular localization annotation: CTP_CleavageSite=33; ConfidenceScore=5.74e-01
MDSSSQHFPPPTLTTANQPLMAPPTKNPRGRPRGSKNKPKSTSLLSQPVEPSVKLVTINVAPGMDVIETILDVARRDHVSLIILNASGMIKNATVCDSPQGVPTLLIGPFSLFSLTGFYLYNNQYALHPGATPPPPFSFGIKLCASHGQVFNGLIGGSVIAGDNVSLMVSTFREPNICKFIPEGKEVNNNDNNA

SEQ ID NO: 233432 - protein, 70 aa, Glycine max
  Coding DNA Sequence Number=SeqID_116654
  Subcellular localization annotation: CTP_CleavageSite=48; ConfidenceScore=5.19e-01
MWIPCGPKQVQTSMQELASKGLASKNVAFSIAVTTHQCSMLSILRRPLATVVEYATTFDNFLYDDGRKPM

SEQ ID NO: 233433 - protein, 194 aa, Glycine max
  Coding DNA Sequence Number=SeqID_116655
  Gene Ontology: Mol. function=DNA binding; Cellular component =chromatin; Biological process=chromosome organization and biogenesis (sensu Eukaryota)
  Homolog annotation: Hit_ID=Q6K709; Match level="QueryCoverage=78%, HitCoverage=54%, E-value=6e-14, Identity=33%"; Hit description=DNA -binding protein-like
  Pfam annotation: Domain name=DUF296; Domain location=53-177; Score =17.3; E_value=1.8e-05; Accession=PF03479.5; Description=Domain of unknown function (DUF296)
  Subcellular localization annotation: CTP_CleavageSite=33; ConfidenceScore=5.65e-01
MDSSSQPFPPPTLAIANQPLMAPPTKNPRCRPRGSKNKPKSTSLSGQPIEPSVKLVTINVVPGMDVMETILDVAHRDHVSVLILNASGTIKNATVCDSPQGVPTLLIGPFSMLSFTGYYLYNNQYALHPGATPPPPFSFGIKLCTSHGQVFNGLIGGSVIAGDNVSLMVSTFREPNICKFIPEGKEGNNNDNNA

SEQ ID NO: 233434 - protein, 81 aa, Glycine max
  Coding DNA Sequence Number=SeqID_116656
MATTVRIALLLCGVIQLGFFKYLQALREVSYAMIDMPTVLQFSSTTKNADEFASRLLDIHSKMLQINKKELRGTKWKYFRT

SEQ ID NO: 233435 - protein, 66 aa, Glycine max
  Coding DNA Sequence Number=SeqID_116657
  Subcellular localization annotation: CTP_CleavageSite=9; ConfidenceScore=5.04e-01
MCNFSWAKRTSTAKRNFSMLSTIEESGRASISGSRAKREIKALSATVVFSQAQCMTGAKLKSTYSR

SEQ ID NO: 233436 - protein, 472 aa, Glycine max
  Coding DNA Sequence Number=SeqID_116658
  Homolog annotation: Hit_ID=Q1SI25; Match level="QueryCoverage=35%, HitCoverage=17%, E-value=5e-48, Identity=60%"; Hit description=NB -ARC domain, putative
NMNTSENGGCLLPGDRYPDWWTFHSEDSSVIFEIPQVNKRNLKTMMCHVHYSSPVNIATDGLKNLLVINHTKTTIQLYKSDALASLEDEEWQRVLSNIEPGNKVEIIVVFGSRLTIVNKTTIYLIYEPMNEKMEHCHAPNKNVIVFNGDENVCNDRSISQVKFKDDVGLVPILRLLKNVVLGVDTNVQNEVNWKKGNQQFTKLLMLKTRVEVVVSEFWQIILSLHKSPGGFKDSSGLMGLLCSNEYSGEDTEVSKPEHFQYAPLVEWTRTCFVGPNFQESERIEGSGAEVFWKHISKRMLLCPCNPCEALCCKLKLKIDDTGPIKYFMCNKVSKERNEVVWKFYWTHGDDVFVKGKTMHLIFNDLWGLQSSPAASAIPTMPPLALARMVLTWLGVASTNCGTRYVSSETAADWATRQYQWRDICNVDQSRHWFLRDRRGLMVLPSRLHTPATTRVLPSRLHTPATARALFAG

SEQ ID NO: 233437 - protein, 461 aa, Glycine max
  Coding DNA Sequence Number=SeqID_116659
  Gene Ontology: Mol. function=binding; Cellular component =mitochondrion; Biological process=protein amino acid phosphorylation
  Homolog annotation: Hit_ID=P0C043; Match level="QueryCoverage=96%, HitCoverage=96%, E-value=1e-129, Identity=52%"; Hit description =Hypothetical PPR-repeat protein At4g17915
  Pfam annotation: Domain name=PPR; Domain location=119-152; Score =17.2; E_value=0.059; Accession=PF01535.11; Description=PPR repeat
  Pfam annotation: Domain name=PPR; Domain location=14-48; Score=5.0; E_ value=1.9; Accession=PF01535.11; Description=PPR repeat
  Pfam annotation: Domain name=PPR; Domain location=153-187; Score =43.8; E_value=5.9e-10; Accession=PF01535.11; Description=PPR repeat
  Pfam annotation: Domain name=PPR; Domain location=188-222; Score =36.5; E_value=9.4e-08; Accession=PF01535.11; Description=PPR repeat
  Pfam annotation: Domain name=PPR; Domain location=223-257; Score =35.6; E_value=1.7e-07; Accession=PF01535.11; Description=PPR repeat
  Pfam annotation: Domain name=PPR; Domain location=258-292; Score =38.0; E_value=3.2e-08; Accession=PF01535.11; Description=PPR repeat
  Pfam annotation: Domain name=PPR; Domain location=293-327; Score =45.8; E_value=1.4e-10; Accession=PF01535.11; Description=PPR repeat
  Pfam annotation: Domain name=PPR; Domain location=328-362; Score =23.1; E_value=0.001; Accession=PF01535.11; Description=PPR repeat
  Pfam annotation: Domain name=PPR; Domain location=363-397; Score =20.9; E_value=0.0046; Accession=PF01535.11; Description=PPR repeat
  Pfam annotation: Domain name=PPR; Domain location=49-83; Score=39.1; E_value=1.6e-08; Accession=PF01535.11; Description=PPR repeat
  Pfam annotation: Domain name=PPR; Domain location=84-118; Score=42.3; E_value=1.7e-09; Accession=PF01535.11; Description=PPR repeat
  Pfam annotation: Domain name=TPR_4; Domain location=118-143; Score =8.1; E_value=4; Accession=PF07721.5; Description=Tetratricopeptide repeat
  Pfam annotation: Domain name=TPR_4; Domain location=292-317; Score =12.0; E_value=1.4; Accession=PF07721.5; Description=Tetratricopeptide repeat
  Pfam module annotation: Pfam domain module=PPR::PPR::PPR::PPR::PPR::PP R::PPR::PPR::PPR::PPR::PPR::TPR_4::TPR_4; Domain location=119-152::14- 48::153-187::188-222::223-257::258-292::293-327::328-362::363-397::49- 83::84-118::118-143::292-317
MPFWAPLKSSLSTKLLNITVSSLCKAKQIPNAETAIVDGIRLGVLPDVVTYNTLIDAYCRFATLDVAYSVLARMHDAGIPPDVVSFNTLISGAVRKSLFSKSLDLFDEMLKRGINPDAWSHNILMNCLFQLGKPDEANRVFKEIVLRDEVHPATYNIMINGLCKNGYVGNALSLFRNLQRHGFVPQVLTYNALINGLCKARRLKDARRVLKEFGETGNEPNAVTYTTVMTCCFRCRLFEEGLEILSEMRSLGFTFDGFAYCTVIAAMIKTGRMQEAEEIVEMMVSSGVRPDLVSYNTLINLYCRQGRLDDALRLLDEIEGEGLECDQYTHTIIVDGLCKAGNFDGAQRHLNYMNSLGFGSNLVAFNCFLDGLGKAGHIDHALRLFEVMEVKDSFTYTIVVHNLCRARRFLCASKVLVSCLKCGYQVLRATQRAVIVGLRSIGYANEARKVKLTIRLAQFVP

SEQ ID NO: 233438 - protein, 117 aa, Glycine max
  Coding DNA Sequence Number=SeqID_116660
  Gene Ontology: Mol. function=RNA-directed DNA polymerase activity; Biological process=RNA-dependent DNA replication
  Homolog annotation: Hit_ID=Q1SSZ9; Match level="QueryCoverage=65%, HitCoverage=16%, E-value=5e-09, Identity=36%"; Hit description =Polynucleotidyl transferase, Ribonuclease H fold
MVQCNSTVNVYQHLPALLSTNQQHIWTPPPTGFGKCNLDAKIFNNSLPFGIDICIRGEHGHFIQVKMSSFNGIPTLAQAEAWALYHALQWTSHLGYQNVILKATGRQLLTILLLLLI

SEQ ID NO: 233439 - protein, 86 aa, Glycine max
  Coding DNA Sequence Number=SeqID_116661
  Subcellular localization annotation: CTP_CleavageSite=58; ConfidenceScore=5.17e-01
MEHKLQGFVKIDRDDSSLPLVTSPIRHATQSFAKFSEKQMSNFHNRNLSTFAVQPSFLASHFGSRWDRNALSDLNGGQVHSWGETP

SEQ ID NO: 233440 - protein, 217 aa, Glycine max
  Coding DNA Sequence Number=SeqID_116662
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=93%, HitCoverage=28%, E-value=5e-35, Identity=44%"; Hit description=WD40 -like
  Pfam annotation: Domain name=WD40; Domain location=150-188; Score =36.4; E_value=1e-07; Accession=PF00400.22; Description=WD domain, G -beta repeat
MSLDDSSISLGLERIRECSGAISNACILHTDEVVSEKLILSGGKAGPKEKISLDEFKGCPQDEAEANIQGKEHELSYTAQEHRPREGVSQEEFQDFHISKRKRINWWKCFVNIKKSGEGNVRSKLNAGTNKTRRIKVKQNKKRCLEFSGLYLGQEVRAHNGLVWTMKFSPCGQYLASGGEDGAIRIWCVTSLDKSSICFTPQDSTAKSKVECDNSSP

SEQ ID NO: 233441 - protein, 62 aa, Glycine max
  Coding DNA Sequence Number=SeqID_116663
MRPRRFRIASMVDSYIVLHRSSFIVRLSTVANPVHFPFLEDAPSSLALPSRRRVGCDSWRLY

SEQ ID NO: 233442 - protein, 115 aa, Glycine max
  Coding DNA Sequence Number=SeqID_116664
MGKVEEIQEKMKVDMEAIKEKMATMMEAMMSANAVAIAATSVVAKVNPTSPFGINESSNLKYGRQRFGKYGMAPMMCKFKTSTPSHHMAWLPTIHHPMWHTLSMKNLNKLHSDTH

SEQ ID NO: 233443 - protein, 47 aa, Glycine max
  Coding DNA Sequence Number=SeqID_116665
MTIAVGLPSLCKTPDNLSQCSVEGSSQKEQMKRPQLRIVNLISGRDC

SEQ ID NO: 233444 - protein, 362 aa, Glycine max
  Coding DNA Sequence Number=SeqID_116666
  Gene Ontology: Mol. function=transporter activity; Cellular component= integral to membrane; Biological process=transport
  Homolog annotation: Hit_ID=Q47EV8; Match level="QueryCoverage=99%, HitCoverage=91%, E-value=2e-27, Identity=26%"; Hit description=Outer membrane efflux protein precursor
  Pfam annotation: Domain name=OEP; Domain location=1-179; Score=23.0; E_value=0.00049; Accession=PF02321.8; Description=Outer membrane efflux protein
  Pfam annotation: Domain name=OEP; Domain location=192-355; Score=7.2; E_value=0.0039; Accession=PF02321.8; Description=Outer membrane efflux protein
  Pfam module annotation: Pfam domain module=OEP::OEP; Domain location =1-179::192-355
MEAHNPDLRAAALALRGVQGDVQTAALRPATELSIGTSKISPKHGIGSGRWQDKRVDSTVGLSWTWERGGKRALRIRQADALLEVAGLEMLDARRRQQVALHETYFALKGAQERAQIADANRQSSAEQMAAADKQVATGAMAPVDRARLAVDDLAVADAAREASLDLRDAQHALGLLLGRDDSHDLSADDPWPEASSVASVRAFDPQQRADLRAARSRLAAADAGVALARSERHRDIELGVEAEREPADISGVTWGVSLTIHARRPVLQREAHAELDQLQASAQSAAQRRSDYEGLQSDAARKAVQGIELAYRRGTASLTDLLDARRSWREFEAALIEARADHAIALARWEAATSIAEGEFR

SEQ ID NO: 233445 - protein, 397 aa, Glycine max
  Coding DNA Sequence Number=SeqID_116667
  Homolog annotation: Hit_ID=Q64EX4; Match level="QueryCoverage=99%, HitCoverage=92%, E-value=1e-116, Identity=49%"; Hit description =MtN19-like protein
  Pfam annotation: Domain name=SURNod19; Domain location=11-395; Score =531.2; E_value=1.1e-156; Accession=PF07712.3; Description=Stress up -regulated Nod 19
MVLSGTTYSIFLESENHIKSATFVSKSFEVGPGKIASKALYDIEFPKGHIGVKSFDAELVDEDGNSVPLYETYLHHWFAIKYNENITMSRYIEQSHDISKGINYTRNDGACRGFMLPHYWGLGGESRGTSSNLPDPFAVEFGNPTNIPHGFKEKWLFDILAIDTRGAYSRKGCTECRCDLLNLPKDFYNVTRDINEQPLSLNYKGGLFCCKDNLQCKLRKGFHGPTRKLSLRYKIRWVDWDEHQVPLKFYILDTTDRVRTNGSSTIHDCQAEYTIPRIGHGDSPHVKKANIPMKKGGYLIYGTSHMHTGVVNATLYGQDGRVLCTSTPKYGTGKEAGNEKGYLVGMSGCYPKPGSVEIKDGEILTLETRYQNKFRTGAMGFFHIHLAEQLPNKDLKV

SEQ ID NO: 233446 - protein, 351 aa, Glycine max
  Coding DNA Sequence Number=SeqID_116668
  Homolog annotation: Hit_ID=Q1SXA8; Match level="QueryCoverage=17%, HitCoverage=4%, E-value=2e-11, Identity=51%"; Hit description=Zinc finger, CCHC-type; Polynucleotidyl transferase, Ribonuclease H fold
MSDEYWVKAMQEELAMYQKNDVWKLVELPKEKFVDEVKWVFRNKFDETCKVGRNKVKVVAKDSNCPNIYGQYHINYGEKEYRFLGYYDADFAEDKVERKSTSGRCHFIGGCLVSRKSKKHGTITLSADLFLFLHPKHLTDTITHHYVLSLSKPYANSSNSLSHKPLCKLTSFPIENPETPNPNNGQETQPTPIFQIAPHFTNNPPTSSRDGSLVQITRPAPMTILATQVTTKDKEPRAYVKHFFDIYSFENVGYIIKAQLMLCGIHHFFEDPKVVVTELIKEFWRTINLQTCCVAQLWSTTETRQKSFSQENISKMRLVDDGSFKQVTPVDDSILAKLQQNLDSTLDGIIS

SEQ ID NO: 233447 - protein, 246 aa, Glycine max
  Coding DNA Sequence Number=SeqID_116669
MDDEVQYEERPSLTHLDRFQHQGSPTVDPNLTAEDIAKEEEDTCPPFTHQDSQAASTTIDLDPPIGIEVLPQPKWKRLHPKESKPSSLMTQGKNVYKIPSRACREKVSYDKDIIGWFHKINTQHIDLSYDDFLPLFLCPKHIQLFTPISKFVPLDYGHQALPLTKDDIYNVGMTMMQCGLTDQWPSYPSGIHIRRTTTSKFMSDHIALALPTLDLRKKKGKVPPQNKSMPYQGLKDNAALRPIPYD

SEQ ID NO: 233448 - protein, 68 aa, Glycine max
  Coding DNA Sequence Number=SeqID_116670
MELHKGPHHGNGAVILTGCKAERFILENVKNGMKKKKCLGVIAAASWRNKCKPPIIYAKTHCIIPSSR

SEQ ID NO: 233449 - protein, 76 aa, Glycine max
  Coding DNA Sequence Number=SeqID_116671
MVRGGDGQQQRWWRMIPFSSSMIMPFEEVLVNFNRWNRKMSENEEDWALRDMFWSSNPSGNQLQDVVIDYRLPVLV

SEQ ID NO: 233450 - protein, 154 aa, Glycine max
  Coding DNA Sequence Number=SeqID_116672
ETKFGHSAPLYHPEAAGPMIRGDTLRLFAPICHPEAAGPMTSRDQVWSFCTLVSSRGGGPDDTRKYPSEADIVFCTFCSSGNNKSFTCGNFMVARDSRQPRGAKLVSYTDFRGPLLDDMRPFFGPCEKAVASGGSNPARLGELSSPGRAELAWA

SEQ ID NO: 233451 - protein, 114 aa, Glycine max
  Coding DNA Sequence Number=SeqID_116673
  Gene Ontology: Mol. function=protein binding; Biological process =defense response
  Homolog annotation: Hit_ID=Q2YE88; Match level="QueryCoverage=76%, HitCoverage=11%, E-value=2e-20, Identity=46%"; Hit description=NBS -LRR type disease resistance protein Rps1-k-1
MADAYEVVNLICVKIKLDKKLLQKLETTPRMVRVVFDDDEKKQITDYNVKNWLNALKDAVYADDYLESLDLKEIAMEHVSWKAPSTSLEDGSHICVKLMLEENNDGEEVYVIPT

SEQ ID NO: 233452 - protein, 62 aa, Glycine max
  Coding DNA Sequence Number=SeqID_116674
MWRIICGNMGIQPWIKRAGANSSSVCVLNSNYIKGGTVNNTKSNYEELKAIGNWHRIEETIS

SEQ ID NO: 233453 - protein, 82 aa, Glycine max
  Coding DNA Sequence Number=SeqID_116675
MCSLKISKSGVAKRLGVTDVFCGNYVYGEWTPPCAYTPNITCVWIIPLACRVAEATEIKEGGIVPFLNPETERLDQGFNLHG

SEQ ID NO: 233454 - protein, 1163 aa, Glycine max
  Coding DNA Sequence Number=SeqID_116676
  Gene Ontology: Mol. function=protein dimerization activity; Cellular component=nucleus; Biological process=regulation of transcription, DNA-dependent
  Homolog annotation: Hit_ID=Q1SGV7; Match level="QueryCoverage=99%, HitCoverage=100%, E-value=0.0, Identity=77%"; Hit description =Transcriptional factor B3; Auxin response factor; Aux/IAA_ARF _dimerisation
  Pfam annotation: Domain name=AUX_IAA; Domain location=952-1127; Score= -96.9; E_value=0.015; Accession=PF02309.7; Description=AUXIAA family
  Pfam annotation: Domain name=Auxin_resp; Domain location=252-334; Score=196.2; E_value=7.7e-56; Accession=PF06507.4; Description=Auxin response factor
  Pfam annotation: Domain name=B3; Domain location=125-230; Score =107.8; E_value=3.1e-29; Accession=PF02362.12; Description=B3 DNA binding domain
  Pfam module annotation: Pfam domain module=AUX_IAA::Auxin_resp::B3; Domain location=952-1127::252-334::125-230
MKAPSNGYLPNSGEGERKTMNSELWHACAGPLVSLPPVGSLVVYFPQGHSEQVAASMQKEADFIPSYPNLPSKLICMLHNVALHADPETDEVYAQMTLQPVNKYEKEAILASDIGLKQNRQPTEFFCKTLTASDTSTHGGFSVPRRAAEKILPPLDYSMQPPAQELVAKDLHDNTWAFRHIYRGQPKRHLLTTGWSVFVSTKRLFAGDSVLFIRDEKQHLLLGIRRANRQQPALSSSVISSDSMHIGILAAAAHAAANNSPFTIFYNPRASPSEFVVPLAKYNKAMYTQVSLGMRFRMMFETEESGVRGYMGTITGISDLDPVRWKSSQWRNIQVGWDESTAGERPRRVSIWEIEPVVTPFYICPPPFFRPKFPRQPGMPASFLISFLNGTTYKPCMHFILIPILVHDDESDMENAFKRAVPWLGDDFGMKDASSSIFPGFSLMQWMSMQQNNQLSAAQSGCFPSMLSSNTLQGNLSTDDPSKLLSFQAPVLSTPSLQLNKPNLPNQINQLQQSPVSWPQQQQLQQQQQQQQQQQQQQQQQQQQQQQQQQQLQSLLQIPMNQLQQQRQQQLPEPQNLPLLQQLPQHLGQQPQKQQQSSQHATIMNNGVVASNQITNQFAQQPMAYGQLQQQQLLSGGIQPQQGIQSATKNTFPLTSLPQDSQFQQQIDQQASLLQRQQQQQQTQLQQSPLQLLQQNLPQRALQQPPATQMLQQNPSEQQLHLQLLQKLQQQQQQQLLSTSTPLLQSQLLQQQNTHQQNQQSLQPLLPISQHQPQQLGNNAFSTEKLLNSNNFSSSLTQSQQLSMNQPQNTQKSHTITRAPSTLTDGDAPSCSTSPSTNNCQVSPPNLLKRNQQIPATLGGGLIVEPTSNLIQELHSKPDTQIKQELLNVKGPDQLKYKGTITDPLEASSSGTSYCLDPGNVQQNLPLSNFCMERDVQSHPRNSLPFDSNLDGLTPDTMLLRGYDSQKDLQNLLSNYASAPRDIETELSTADISSQSFGVPNMPFKPGCSSDVGINDTGVLNNNNGLRTNQTPRMRTYTKVQKRGSVGRCIDVTRYKGYDELRHDLARMFGIEGQLEDPLRTDWKLVYVDHENDILLVGDDPWDEFVSCVQSIKILSSAEVQQMSLDGDLGGNVPIPNQACSGTDSGNAWRGQYEDNSAASFNR

SEQ ID NO: 233455 - protein, 136 aa, Glycine max
  Coding DNA Sequence Number=SeqID_116677
MHLCHIHIWSHSFSANFQIPLDSEPYVPIKRSFLIGAAVIASFGYRKEHDGSWLKKGAQPTDEEGNLPVEDNSTLLRRLMDKFDGLQTFVGDKFDAMELQVDMRLDAMESRITKVEEDVSFIRTCFDPPPPPPSSS

SEQ ID NO: 233456 - protein, 219 aa, Glycine max
  Coding DNA Sequence Number=SeqID_116678
  Gene Ontology: Mol. function=DNA binding
  Homolog annotation: Hit_ID=Q1SDS1; Match level="QueryCoverage=85%, HitCoverage=34%, E-value=2e-18, Identity=32%"; Hit description=IMP dehydrogenase/GMP reductase
MFGSKGENLGKSRRIGPAHGHPGTLDLRGAIDAFLAFYDRKESPVVAILADLYGTFDRRCEKNSARIVCCTTTLYVWLVSHLFRQEVRHVCPLEGHRSCTEKKEANWDRLLASKEGASVNWFPRWKEGRTGILISCGEFPNVPLMGTRGCINYNLVLAIRQLGYPMREAPLEEGFTPFIARGFNNTNAGVLQRVRKAWERVPKKDEELRGSSNGPIGGY

SEQ ID NO: 233457 - protein, 147 aa, Glycine max
  Coding DNA Sequence Number=SeqID_116679
EKYQHRRDEILQHSTEEDTSTQDSPKTATSVNDNEIYLNVVGGPNYKGERVWARYFEQKANKEKTLEEKMLQMMENHDHQSKEMRQQMQEQNKQIRQQNEQMQCILQYLHSQSIIPTPSLSPTIADGIEHHVNDAQVDHPHDMGNNH

SEQ ID NO: 233458 - protein, 243 aa, Glycine max
  Coding DNA Sequence Number=SeqID_116680
  Gene Ontology: Mol. function=sugar porter activity; Cellular component=membrane; Biological process=transport
  Homolog annotation: Hit_ID=Q8GZZ6; Match level="QueryCoverage=94%, HitCoverage=91%, E-value=9e-63, Identity=47%"; Hit description =Putative phosphate/phosphoenolpyruvate translocator protein
  Pfam annotation: Domain name=DUF6; Domain location=18-151; Score =14.3; E_value=0.01; Accession=PF00892.11; Description=Integral membrane protein DUF6
  Pfam annotation: Domain name=TPT; Domain location=78-240; Score= -34.1; E_value=0.055; Accession=PF03151.7; Description=Triose -phosphate Transporter family
  Pfam annotation: Domain name=UAA; Domain location=18-243; Score= -134.5; E_value=0.0011; Accession=PF08449.2; Description=UAA transporter family
  Pfam module annotation: Pfam domain module=DUF6::TPT::UAA; Domain location=18-151::78-240::18-243
MMMMNNTIIPWSTIGVVIAWYTSNIGVLLLNKYLLSNYGFRFPVFLTTCHMLVCSLFSYVIVSVTEAVPLQRVRSRSQFWRIVALGVVFCFSVVCGNVSLRYIPVSFNQAIGATTPFFTAVFAYAVSAKREAWVTYATLLPVVAGVVIASGRKVEFYEPAALYGSNSSDGLTSYNIVDGGKCDSDHYGSCQKGYKNFLVLGNAKGAVAVVVSILIFKNPISMIGMLGYALTIIGVILYSETKK

SEQ ID NO: 233459 - protein, 144 aa, Glycine max
  Coding DNA Sequence Number=SeqID_116681
  Gene Ontology: Mol. function=transporter activity; Cellular component= mitochondrial inner membrane; Biological process=mitochondrial transport
  Homolog annotation: Hit_ID=Q9MBE6; Match level="QueryCoverage=68%, HitCoverage=36%, E-value=7e-44, Identity=85%"; Hit description=SfUCPb
  Pfam annotation: Domain name=Mito_carr; Domain location=39-127; Score= 61.8; E_value=2.2e-15; Accession=PF00153.17; Description =Mitochondrial carrier protein
MDEESSFVDDLFCIIGGLHGDSMLYIVDFCPEIDLACYIFVTDFLVCTIPLDTAKVRLQLQKQAVAGDVVSLPKYKGMLGTVGTIAREEGLSALWKGIVPGLHRQCLYGGLRIGLYEPVKTFYVGKDHVGDVPLSKKILAAFTT

SEQ ID NO: 233460 - protein, 72 aa, Glycine max
  Coding DNA Sequence Number=SeqID_116682
MGTLSKLLLGGLDIVPFKKLNCGQFGMVCVWLVTKGFLKFWWKLTVWRQLDSWRTIVNMQISSGSSFMRFEI

SEQ ID NO: 233461 - protein, 160 aa, Glycine max
  Coding DNA Sequence Number=SeqID_116683
  Homolog annotation: Hit_ID=Q9LVD5; Match level="QueryCoverage=99%, HitCoverage=100%, E-value=3e-74, Identity=76%"; Hit description =Arabidopsis thaliana genomic DNA, chromosome 5, P1 clone:MJB24
MEDPSFFDRMISHLRATCMHYTGYPKDLGPSQVIHFTSEREFVNLLHEGFPVVVAFTIRGNYTRHLDKVLEESAAEFYPNVKFMRVECPKYPGFCITRQKKEYPFVEIFHSPTHAANQGRVADPNITKYNVKVLPFNYDVSAYGFREFFKRHGIRASDPK

SEQ ID NO: 233462 - protein, 270 aa, Glycine max
  Coding DNA Sequence Number=SeqID_116684
  Gene Ontology: Mol. function=RNA-directed DNA polymerase activity; Biological process=RNA-dependent DNA replication
MWMDRFALTLNGSQELPRLLAKAKAMADAKDAITKRAPRHPYCTRSKSRMMGDLEEVQEQMKADMSALKEQMSSMMDDMLGMKQLIESNTATVAAGSTLGHINNPHPGYNRGTYPYGLRPNYTPPAIHEDVGHVPPLILEEEPLQHPDGVHENPREHAQGDVDSYSPFPAEGLAPNTLPQPNITGEPRRHPTQPMFLSMGGPPPIVEGKGKLDLIEERLRADEGFGDYPFADMTDLCLVPDVVIPLKFKVPDFDRYKGTTCPKNHLKMYC

SEQ ID NO: 233463 - protein, 99 aa, Glycine max
  Coding DNA Sequence Number=SeqID_116685
MAFLGETSSQIVVNSTLGFIFPNGSIVHNDGGVSFQASTLVPIRVPNGIARTPDGILNLLETTMTPTHDALLYYNGRWNMSRQNEFVGYSFTGKNPKNF

SEQ ID NO: 233464 - protein, 61 aa, Glycine max
  Coding DNA Sequence Number=SeqID_116686
MLSGTEASSTLQISSKRSQRSDHGQPTVNEGWAAFLPRQLHVAFSRSFIKKVPPEASSWLL

SEQ ID NO: 233465 - protein, 64 aa, Glycine max
  Coding DNA Sequence Number=SeqID_116687
MKPVVVVEFWSEAGDWAQSLFDVERMRPLQQGTEAPTNFKIPSENEFGAGGLRSILDDTSGRSA

SEQ ID NO: 233466 - protein, 472 aa, Glycine max
  Coding DNA Sequence Number=SeqID_116688
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=69%, HitCoverage=47%, E-value=5e-48, Identity=50%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=286-346; Score =54.2; E_value=4.2e-13; Accession=PF08276.2; Description=PAN-like domain
  Pfam annotation: Domain name=Pkinase_Tyr; Domain location=376-472; Score=-157.0; E_value=0.0077; Accession=PF07714.7; Description =Protein tyrosine kinase
  Pfam annotation: Domain name=S_locus_glycop; Domain location=157-274; Score=77.2; E_value=5.1e-20; Accession=PF00954.11; Description=S -locus glycoprotein family
  Pfam annotation: Domain name=efhand; Domain location=64-92; Score =19.3; E_value=0.014; Accession=PF00036.22; Description=EF hand
  Pfam module annotation: Pfam domain module=PAN_2::Pkinase_Tyr::S _locus_glycop::efhand; Domain location=286-346::376-472::157-274::64 -92
MAAQENNFQDYLPVMANKLGGDGLIDELCNGFDLLKDSDKGVITFESLKRNSYLLGLQGLSDEDLRSMVLEGDFDGDGALNQMEFCVLMFRLSPELMEGSKMWLEQELMLYPSNMNVRKHGDNAMSLGKEAIPGSWKNWDDSSPGDFTWGISLEGFPQVIMWKGSKEFYHGSHWSGLGFSGALELKANPVFEFKFVSNEDEVYYTYSLRNESLVSRIVMNQTISTRQRYIWIEKAQSWRLYASVPRDNCDFYNLCGSNGNRVIDRPGNWDIMDWTQGCFLTEKWNCEERRKHGFAKLSGLKAPDTSHSWVNESMSLNECREKGLENCSCKAYANSDVRGGGSGNNLMVENNEENVKEDLELPLVDLAAIVKATDGFSINNKLGEGGFGAVYMGTLDDGHEIAVKRLSQSSGQGFNEFKNEVILIAKLQNRNLVKFLGRCIEGEEKMVIYEYMPNKSLEFFIFGYDLFTSYAI

SEQ ID NO: 233467 - protein, 60 aa, Glycine max
  Coding DNA Sequence Number=SeqID_116689
MKRGMWGGIFQEGEGIDSLKTTKQQRGTNSVRDTHGFTLVWTFVEVVKRVESSTILFGFV

SEQ ID NO: 233468 - protein, 173 aa, Glycine max
  Coding DNA Sequence Number=SeqID_116690
  Gene Ontology: Mol. function=protein serine/threonine kinase activity; Cellular component=membrane; Biological process=protein amino acid phosphorylation
  Homolog annotation: Hit_ID=Q1S7G7; Match level="QueryCoverage=99%, HitCoverage=54%, E-value=1e-48, Identity=56%"; Hit description =Protein kinase
MARTFWGDQIEGNTRRVVGTYGYMASEYAIYGLFSVKSDVFSFGVLMLEIVSGKKNRGFSHSNNGINLIGQGWRFWRESRPLDLIDSCMENSSVLLEALCCIHIGLLCVQQNPEDRPSMSTVVVMLSSESALPQPKEPPFFLKNDKFCLEADSSTKHKFSSTNDISVTMLEPR

SEQ ID NO: 233469 - protein, 770 aa, Glycine max
  Coding DNA Sequence Number=SeqID_116691
  Gene Ontology: Mol. function=protein serine/threonine kinase activity; Cellular component=membrane; Biological process=protein amino acid phosphorylation
  Homolog annotation: Hit_ID=O81833; Match level="QueryCoverage=94%, HitCoverage=95%, E-value=0.0, Identity=47%"; Hit description =Putative receptor protein kinase
  Pfam annotation: Domain name=B_lectin; Domain location=69-183; Score =146.9; E_value=5.6e-41; Accession=PF01453.15; Description=D-mannose binding lectin
  Pfam annotation: Domain name=PAN_2; Domain location=333-398; Score =110.7; E_value=4.1e-30; Accession=PF08276.2; Description=PAN-like domain
  Pfam annotation: Domain name=Pkinase; Domain location=456-724; Score =156.3; E_value=7.8e-44; Accession=PF00069.15; Description=Protein kinase domain
  Pfam annotation: Domain name=Pkinase_Tyr; Domain location=456-724; Score=128.8; E_value=1.5e-35; Accession=PF07714.7; Description =Protein tyrosine kinase
  Pfam annotation: Domain name=S_locus_glycop; Domain location=197-322; Score=135.8; E_value=1.2e-37; Accession=PF00954.11; Description=S -locus glycoprotein family
  Pfam module annotation: Pfam domain module=B_lectin::PAN _2::Pkinase::Pkinase_Tyr::S_locus_glycop; Domain location=69-183::333- 398::456-724::456-724::197-322
MEGFTLLLFCLALLNSIAAATVRETISTLQSINDDQIIVSPGKTYALGFFSPGNSKNRYVGIWYNEIPTQTVVWVANRDNPLADSSGVLKLNETGALVLLNHNKSVVWSSNASKPARYPVAKLLDSGNLVVQDGNDTSETKDLLWQSFDYPGDTILPGQKFGRNLVTGLNRFMSSWNSTDDPSQGEYSYQIDISGYPQLVLREGAFKRYRFGSWNGIQFSGAPQLKQNNFTRFSFVSDEEELYFRFEQTNKFVFHRMQLSTDGYILGDYWNTEEKVWSLHGKIPVDDCDYYDKCGAYASCNINNVPPCNCLDGFVSKTDDIYGGCVRRTSLSCHGDGFLKLSGLKLPDTERSWFNRSISLEDCRTLCMNNCSCTAYAALDVSKGPTGCLLWFDDLVDIRDFTDVDEDIYIRVAGTEIGKMKDKLERDASVIYEHEKDDLELPMFEWSTITCATNNFSPDNKLGEGGFGSVYKGILDDGGEIAVKRLSKNSSQGLQEFKNEVMHIAKLQHRNLVRLLGYCIQAEERLLVYEFMANKSLDSFIFDENKSMLLDWPRRSLIINGVARGLLYLHQDSRHRIVHRDLKAGNVLLDSEMNPKISDFGLARSFGGNEIEATTKHVVGTYGYLPPEYIIDGAYSTKSDVFSFGVLILEIVSGKRNKGFCHQDNLLAHVWRLFTEGKCSEIVDATIIDSLNLPEVLRTIHVGLLCVQLSPDDRPNMSSVVLMLSSESELPQPNLPGFFTSTSMAGDSSSSSSYKQYTNNDMTVSIMSAR

SEQ ID NO: 233470 - protein, 62 aa, Glycine max
  Coding DNA Sequence Number=SeqID_116692
MGKFKLSAQSRSMRNTGLVQEDPQGSLDARLARKSVLSAMLAWKGNALKNGYFLKNWGRISE

SEQ ID NO: 233471 - protein, 314 aa, Glycine max
  Coding DNA Sequence Number=SeqID_116693
ITPSVSLPVLRLIDELQRLTRADPLADTLPAQGLHFTFLPLTLPLYNVNEPLPAKAAQLTTIWQEFAAKKIVIRDLRLVALPSQLLLAGIPDTPAIAMRQSFCDKVLDSDWKKELLMRHGNSPLPAPFWHSTLLRYSAEFLPAVLRQFFYERQDINFGAVAGELMLAKANYNWTNAHNHDYVKYGIPSGIAVLQFRPLRLLAGPQLIPPRRYYVKTYPTGPFDGHHGDILVRINAHPTTDCPLPPHAVVRFRPSRLLQGPQRIPPRRHYVKTYPTGPFDGHHCVILVRINAHPTTEYPVSFALGASTISLAHPQ

SEQ ID NO: 233472 - protein, 298 aa, Glycine max
  Coding DNA Sequence Number=SeqID_116694
  Gene Ontology: Mol. function=nucleoside-triphosphatase activity; Biological process=protein metabolic process
  Homolog annotation: Hit_ID=Q7WQZ4; Match level="QueryCoverage=46%, HitCoverage=31%, E-value=5e-69, Identity=95%"; Hit description=ATP -dependent hsl protease ATP-binding subunit hslU
RHQGVEDAVFGGILGLGAHAAHFQFAGLLDGVFGQVADDGVDVAADVAHLGELGGLDLDERRVGQLGQAARDLGLAHAGGADHQDVLGVDLVAQRLGHLLAAPAVAQGHRHRALGAVLADDVLVEFGDDLSGRHVGCGHEGGSLKQGWAGRRAAAPRTGAARLASVAQRLDDVVLVGVDAEVAGDLERLLDDGLGRQLGIAQQRQRGGLGIGAARADGGQAVLGFEHVAVAGQHQRVLGVGHDQHGFEPAQDAVGAPVAGQFDRRAHQVALVFLELGFETLLQRERVGGGAGEAGQDL

SEQ ID NO: 233473 - protein, 121 aa, Glycine max
  Coding DNA Sequence Number=SeqID_116695
GVVLAEVLLADSRFTRPDMGFHPTKLNFVPSDADEAPPDVSICLHAFGIVGCGSFSGVKSCEREDPFHPGLFVGDAGGFQSPTREPLNVGGLVPPHCSLKSVVSDDACPGACFVQRDATTL

SEQ ID NO: 233474 - protein, 338 aa, Glycine max
  Coding DNA Sequence Number=SeqID_116696
MASDQHNMLHEEGGGKSTCSRSRRSNGKGPKKPPQRGLGVAQLERLRLQESWKKMSEGSSSGGGVLQVPLPTLHDHYHQQQQLFQCHPPHPPVFAASGGVPVRHGAPSPPTPNLGFQYFQYPQQQQVMINGSNNSTIGGGWMLPNRVDSFGSVSPLLVGTPLETSKELSSIPNLHSQHECFDFCLKKTRFNEYNEKGSSNARRERALEIGPNGNGHDFLGFMPQSSAPSFVGETRDFYNKLVYHDAAAASAYTCSTPNLDECVEVVAVHRRGNSGCGRVFMEYEFFPGKDGSGTTSKELELPSIGSVSVGGGEASSITVAAYGDSASNYVDLSLRLSR

SEQ ID NO: 233475 - protein, 195 aa, Glycine max
  Coding DNA Sequence Number=SeqID_116697
  Homolog annotation: Hit_ID=Q04129; Match level="QueryCoverage=40%, HitCoverage=100%, E-value=7e-21, Identity=64%"; Hit description =Wound induced protein
MSAASRAWIVASSIGAVEALKDQLGVCRWNHALRSLQQHAKSNIRSYTQAKTLSSATSAAVSNKVKRTKEESMRKVMDLSCWAGNAPIGNAPRHCPSGKCTLKLAEVDDVAIPQNTIYTLELAEVDAAVEARKKPPVEEMNGFREEDRLIRITPHSHECYGSDDRIVLLTVATGGHHAAFTAYWDPPNKGIPTLH

SEQ ID NO: 233476 - protein, 68 aa, Glycine max
  Coding DNA Sequence Number=SeqID_116698
MGVKFLEAIMQRSHPNKQMVSVCHQTRSSLDGEKGQYDRDCGAADKSETLASKYPQFVMRNSDLRSSG

SEQ ID NO: 233477 - protein, 111 aa, Glycine max
  Coding DNA Sequence Number=SeqID_116699
  Homolog annotation: Hit_ID=Q9FL72; Match level="QueryCoverage=87%, HitCoverage=34%, E-value=3e-26, Identity=60%"; Hit description =Arabidopsis thaliana genomic DNA, chromosome 5, P1 clone:MDK4
  Pfam annotation: Domain name=DUF1223; Domain location=1-111; Score= -101.7; E_value=0.0083; Accession=PF06764.2; Description=Protein of unknown function (DUF1223)
  Subcellular localization annotation: CTP_CleavageSite=63; ConfidenceScore=5.07e-01
MGCVMNKASPIGVIILKAIIPKSHLKNLSKQATFNRPTATPLEVTLNGALRTKADNRGVDVTVAFYEAGLVTDCPRGENKGHVLSNDYVVRKLEKLCTVKDHPAKKTVLGT

SEQ ID NO: 233478 - protein, 56 aa, Glycine max
  Coding DNA Sequence Number=SeqID_116700
MNIGLCKEFNAKTTGCFGLSGWKRIKEKENQGRCTHCLEQNPHGSLSYTRLTVHAV

SEQ ID NO: 233479 - protein, 343 aa, Glycine max
  Coding DNA Sequence Number=SeqID_116701
  Gene Ontology: Mol. function=protein serine/threonine kinase activity; Cellular component=membrane; Biological process=protein amino acid phosphorylation
  Homolog annotation: Hit_ID=Q70I30; Match level="QueryCoverage=98%, HitCoverage=47%, E-value=6e-92, Identity=51%"; Hit description=S -receptor kinase-like protein 1
  Pfam annotation: Domain name=PAN_2; Domain location=82-148; Score =108.8; E_value=1.6e-29; Accession=PF08276.2; Description=PAN-like domain
  Pfam annotation: Domain name=Pkinase; Domain location=145-342; Score=- 50.5; E_value=1.5e-05; Accession=PF00069.15; Description=Protein kinase domain
  Pfam annotation: Domain name=Pkinase_Tyr; Domain location=194-342; Score=-123.9; E_value=7.2e-05; Accession=PF07714.7; Description =Protein tyrosine kinase
  Pfam annotation: Domain name=S_locus_glycop; Domain location=1-65; Score=-3.1; E_value=6.3e-05; Accession=PF00954.11; Description=S -locus glycoprotein family
  Pfam module annotation: Pfam domain module=PAN_2::Pkinase::Pkinase _Tyr::S_locus_glycop; Domain location=82-148::145-342::194-342::1-65
MITLTGQIQRFILSDLTNSWQLFYTGPADRCDNYAICGVNSNCDVNNSPTCECLQGFIPKSLEKWNSQNWTDGCVRKVNLDCGNSDGFLKYQGMKLPDTSISWFDRSMNLEECENICLRNSSCSTYANLDVRDGGSGCLLWFNNIVDVRKLTSGGQDFYIRVAASELGADTLFSSAFLILAFPLKHTIFRAHVINFILVAGILVGCIVFIVVMIILGVAILRMKKLEKPVEARKSLLNWAQCFQIICGIARGLLYLHEDSRLRIIHRDLKTSNILLDESMNPKISDFGLARTFGGDEVEGQTKRVVGTYGYISPEYAARGNFSVKSDVFSFGVILLHIFHYLT

SEQ ID NO: 233480 - protein, 93 aa, Glycine max
  Coding DNA Sequence Number=SeqID_116702
MRELSFQRRDLEGLPQKIHSYICVRITFFALEKKKTLSSSEKEQWWATKKTIIYTQINLCETNKTFDFDPLTYNWYGTVVAPFDRTQSSGLLK

SEQ ID NO: 233481 - protein, 826 aa, Glycine max
  Coding DNA Sequence Number=SeqID_116703
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=94%, HitCoverage=94%, E-value=0.0, Identity=58%"; Hit description=Protein kinase; S-locus glycoprotein; Curculin-like (Mannose-binding) lectin; Apple-like
  Pfam annotation: Domain name=B_lectin; Domain location=71-185; Score =144.5; E_value=2.9e-40; Accession=PF01453.15; Description=D-mannose binding lectin
  Pfam annotation: Domain name=PAN_2; Domain location=341-407; Score =120.6; E_value=4.4e-33; Accession=PF08276.2; Description=PAN-like domain
  Pfam annotation: Domain name=Pkinase; Domain location=514-785; Score =157.7; E_value=3e-44; Accession=PF00069.15; Description=Protein kinase domain
  Pfam annotation: Domain name=Pkinase_Tyr; Domain location=514-785; Score=132.1; E_value=1.5e-36; Accession=PF07714.7; Description =Protein tyrosine kinase
  Pfam annotation: Domain name=S_locus_glycop; Domain location=199-324; Score=156.5; E_value=6.9e-44; Accession=PF00954.11; Description=S -locus glycoprotein family
  Pfam module annotation: Pfam domain module=B_lectin::PAN _2::Pkinase::Pkinase_Tyr::S_locus_glycop; Domain location=71-185::341- 407::514-785::514-785::199-324
MDSYEVMIVWFSLLFSLIPSISTRLSSITLDQPLHHNETLVSASGTFEAGFFSTGSSQRQYFCICYKNISPRTIVWVANRNTPLDNNFTGVFKVSDEGNLVVLDGIGASVWSSNASTTSQKPIVQLLDSGNLVVKDGGTNSPEKVVWQSFDFPGDTLLPGMKLRSSLVTGAHSSLTSWRDTEDPALGEYSMYIDPRGFPQRVTTKGGTWLYRAGSWNGYQFSGVPWQLLHNFFNYYFVLTPKEVYYEYELLEPSVVTRFVINQEGLGQRFTWSERTQSWELFASGPRDQCENYGLCGANSVCKINSYPICECLEGFLPKFEEKWRSLDWSDGCVRGTKLGCDDGDGFVKYEGMRLPDTSSSWFDTSMSLDECESVCLKNCSCTAYTSLDIRGDGSGCLLWFGNIVDMGKHVSQGQEIYIRMAASELDQTWHKRHASTKLVVILATIATFIVGLILGSVIYIRRKLGKPAYYLSASISGKTNIIDQMHHSIKHEKKDIDLPTLDLSTIDNATSNFSASNILGEGGFGPVYKGVLANGQEIAVKRLSKNSGQGLDEFRNEVVLIANLQHRNLVKILGCCIQDDERILIYEFMPNRSLDLYIFDRTRKKLLDWNKRFQIISGIARGLLYLHHDSRLRIIHRDIKTSNILLDNDMNPKISDFGLARMLVGDHTKANTKRVVGTHGYMPPEYAVYGSFSVKSDVFSFGVIVLEIVSGRKNTKFLDPLNQLNLIGHAWRLWSEGRTLELIDESLDDSIIESEVLKIVHVGLLCVQERPEDRPNMSSVVLMLNGDRPLPRPKLPAFYPHQEDFSSSSKCEFSSNELSITLEAR

SEQ ID NO: 233482 - protein, 175 aa, Glycine max
  Coding DNA Sequence Number=SeqID_116704
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=99%, HitCoverage=22%, E-value=7e-61, Identity=63%"; Hit description=EGF -like, subtype 2; S-locus glycoprotein; Curculin-like (Mannose- binding) lectin; ...
  Homolog annotation: Hit description=Apple-like; Serine/threonine protein kinase, active site
MNPKISDFGLARTLWGDQVDANTNKIAGTYGYMPPEYAVHGHFSMKSDVFSFGVMVLEIVSGKKNRDFSDPNHCLNLLGHAWRLWTEGRPTNLMDAFLGERCTSSEVIRCIHVGLLCVQQRPNDRPDMSAVVLMLNGEKSLPQPKAPGFYNGRDKADLFGPFSNNDASLTVLEAR

SEQ ID NO: 233483 - protein, 66 aa, Glycine max
  Coding DNA Sequence Number=SeqID_116705
MPYKEMALRKLSAKRSRKDAAAEGPMPLPSLTAIVSGALSTSSVSRPSKDGHSTERDVSNSGTMNT

SEQ ID NO: 233484 - protein, 462 aa, Glycine max
  Coding DNA Sequence Number=SeqID_116706
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=97%, HitCoverage=55%, E-value=1e-108, Identity=45%"; Hit description =Protein kinase; S-locus glycoprotein; Curculin-like (Mannose -binding) lectin; Apple-like
  Pfam annotation: Domain name=B_lectin; Domain location=70-183; Score =147.4; E_value=3.8e-41; Accession=PF01453.15; Description=D-mannose binding lectin
  Pfam annotation: Domain name=PAN_1; Domain location=331-409; Score =9.0; E_value=0.02; Accession=PF00024.16; Description=PAN domain
  Pfam annotation: Domain name=PAN_2; Domain location=331-396; Score =112.5; E_value=1.3e-30; Accession=PF08276.2; Description=PAN-like domain
  Pfam annotation: Domain name=S_locus_glycop; Domain location=197-322; Score=86.0; E_value=1.2e-22; Accession=PF00954.11; Description=S -locus glycoprotein family
  Pfam module annotation: Pfam domain module=B_lectin::PAN_1::PAN_2::S _locus_glycop; Domain location=70-183::331-409::331-396::197-322
MQNLRTQWFWFFLFCCISRTSTSLDSIAPNQSISDGETLISHEKTFELGFFSPGSSKSRYLGIWYYNINPRTMVWVANREAPLNTTSGVLKLSDQGLVLVNGTNNIVWSSNMSTTAETENTIAQLLDSGNLVVKDGNSEYEHYLWQSFDHPCDTLLPGMKLGWNLEKGEELFLSSWKSADDPSHGEYSFKIDPRGCPQAVLWKGTNLSNRFGPWNGLYFSGSLIDSQSPGVKVDFVLNKKEIYYQFQVLNKSLSYRFWVTPNRNALVSLWESQISDWLILYSQPSFPCEYYGRCGANSICNAGNPRCTCLDGFFRHMNSSKDCVRTIRLTCNKDRFRKYTGMVLPDTSSSWYNKNMVLEECAEMCLQNCSCTAYANLDISGGGSGCLLWYHDLIDLRHYPQAQGGQDIYIRYSDSELDHSQKNGLSKSKIASIVTGSTTFVVSMILGLVIWLWKRKVEMEGG

SEQ ID NO: 233485 - protein, 81 aa, Glycine max
  Coding DNA Sequence Number=SeqID_116707
  Gene Ontology: Mol. function=transition metal ion binding; Biological process=proteolysis
MAGTPQCQLEMYFPSAFFDIMIHLIVHLVREIKCCDPVYLWWMDPVERYIKILKGYTMNLYRLEASIVKRYIAEEAIEFCS

SEQ ID NO: 233486 - protein, 327 aa, Glycine max
  Coding DNA Sequence Number=SeqID_116708
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=95%, HitCoverage=42%, E-value=1e-115, Identity=63%"; Hit description=EGF -like, subtype 2; S-locus glycoprotein; Curculin-like (Mannose- binding) lectin; ...
  Homolog annotation: Hit description=Apple-like; Serine/threonine protein kinase, active site
  Pfam annotation: Domain name=Pkinase; Domain location=39-284; Score =81.4; E_value=2.7e-21; Accession=PF00069.15; Description=Protein kinase domain
  Pfam annotation: Domain name=Pkinase_Tyr; Domain location=39-284; Score=61.0; E_value=3.3e-16; Accession=PF07714.7; Description =Protein tyrosine kinase
  Pfam module annotation: Pfam domain module=Pkinase::Pkinase_Tyr; Domain location=39-284::39-284
MEGMKKIFHQSRHNSKLRKEEPDLPAFDLPFIAKATDNFSDANKLGEGGFGPVYKGTLIDGQDIVVKRLSNTSGQGMEEFKNEVALIARLQHRNLVKLHDEIRSKILDWSKRFHIIGGIARGLVYLHRDSRLSIIHRDLKASNILLDENMNSKISDFGLARTLWGDQVDANTNKIAWTYGYMPTEYAVHGHFSMKSDVFSFGVMVLEIVSGKKNRDFSDPEHFLNLLGHAWRLWTEGRPTDLMDAFLCERCTSSEVIRCIHVGLLCVQQRPEDRPDMSAVVLMLNGDKLLPQPKVPGFYHGSDKAYLSGKFKSFSYNDVSLTVLGAR

SEQ ID NO: 233487 - protein, 74 aa, Glycine max
  Coding DNA Sequence Number=SeqID_116709
MEETKVSRSVLRSSIISKKWPLAVSVYTEGIAQTCIIALCNGKRGNPLYDDDDRGGGPGESSHTKHHYSQSPQL

SEQ ID NO: 233488 - protein, 45 aa, Glycine max
  Coding DNA Sequence Number=SeqID_116710
EIKSESTNKSFKVNEHRLKPFLINPSLVDVVVEETSLLHPTSLPP

SEQ ID NO: 233489 - protein, 50 aa, Glycine max
  Coding DNA Sequence Number=SeqID_116711
  Homolog annotation: Hit_ID=Q6YXP2; Match level="QueryCoverage=54%, HitCoverage=16%, E-value=9e-07, Identity=78%"; Hit description =Photosystem I assembly protein ycf3
KFSSTVLRKGIDSPIPTEENRPFDRETRKLRSLGLIKPLNIGNKAIAPNP

SEQ ID NO: 233490 - protein, 367 aa, Glycine max
  Coding DNA Sequence Number=SeqID_116712
  Gene Ontology: Mol. function=helicase activity; Cellular component =membrane; Biological process=viral genome replication
  Homolog annotation: Hit_ID=Q1SN45; Match level="QueryCoverage=99%, HitCoverage=21%, E-value=8e-98, Identity=49%"; Hit description=AAA ATPase
  Pfam annotation: Domain name=DUF889; Domain location=34-285; Score =414.9; E_value=1.1e-121; Accession=PF05970.5; Description=Eukaryotic protein of unknown function (DUF889)
MAHKLCFEALDQSLRDIITDKSKSNQIFGGKVIVFGGDFCQILPVIPRGMRSDIVNVAINSSYLRDSCEILTLTKNMRLHSNLESVDEQETATFAKWILDIGDGIIDDENDGYDKIQIPAHLLITQYDDPMSAIVKSTFPDLDQHHNNPEFFKSKAILALTNETVEQINDYVLSFIPGDHMEYLSSDSIDKSETSENSYFQSITTEFLNSLKTSGLPTHSIKLKIGSPIMLLRNLDQNQGLCNDTRLVVTKMAKHVIVAEIILGKNIGLAIYIPRMSMSPSQSPWPFKLLRRQFPIMLSYAMTINKSQGQSLSMVGLYLPKPVFTHGQLYVALSRVNSAKGLKILIHDDEQKSMNSTTKEVFRNIKT

SEQ ID NO: 233491 - protein, 38 aa, Glycine max
  Coding DNA Sequence Number=SeqID_116713
MTLFIFPGGYQYVHGKSNSPERAPDRQPKVLNHDPSLG

SEQ ID NO: 233492 - protein, 151 aa, Glycine max
  Coding DNA Sequence Number=SeqID_116714
MPSGPEEVQQGPGVPALVTGLCQSYRVPVPPTRSCHRDIEKSNRALGFPALVTGLCSPLGCPFPPARSRHHDIGIAPARHPVDPKKSNRVLELSSSNYGQAQGETPQQPGDGQQRATDAPASPLEFTSAHPQKAIKRPAQDVKEVLLGGNL

SEQ ID NO: 233493 - protein, 234 aa, Glycine max
  Coding DNA Sequence Number=SeqID_116715
  Gene Ontology: Mol. function=caspase activity; Cellular component =membrane; Biological process=proteolysis
  Homolog annotation: Hit_ID=Q355U6; Match level="QueryCoverage=77%, HitCoverage=60%, E-value=2e-36, Identity=43%"; Hit description =Probable periplasmic nitrate reductase precursor
  Pfam annotation: Domain name=DUF323; Domain location=25-232; Score =79.1; E_value=1.4e-20; Accession=PF03781.6; Description=Domain of unknown function (DUF323)
MRRPLAAVFLVLMTACGPAERARSLSPDVSRLPPGQVAYLPPGETLRNGYPVSPAPLRAELARGVVIMTRQVSQAEYAACVRAGACKPLDPGFRDLDAPDLPAIGLSWSDASAYAAWLSDRSGQRWRLPTYAEWVYAAGDAYREETPLPASDADPAQRWLAEYDAQTRRGQEATEVRPFGAYGTNATGLMDMAGSVWEWTDDCYTRRILALTQGGQAGTAGPDNSTDRNCGILV

SEQ ID NO: 233494 - protein, 237 aa, Glycine max
  Coding DNA Sequence Number=SeqID_116716
  Gene Ontology: Mol. function=DNA binding
  Homolog annotation: Hit_ID=Q1SP03; Match level="QueryCoverage=82%, HitCoverage=38%, E-value=2e-20, Identity=32%"; Hit description=IMP dehydrogenase/GMP reductase
MRYRSFDLHQLLSHFSKHGNKSNRQEVYQVKVKSLDTTSIKELGRLMEPLQMQTFRKTYGKILELTIAEVSIEAIVSLTQYYDQPLRCFTFGDFQLVPTIEEFEEIIGCPLGGRKPYLSSGCLPSLSRIATVVKDSARGLDRIKQTRNGIAGLPQRYLEDKARGMANQGDWVPFMDVLALLIFGVVLFPNVDGLIYLTHLTEGAKRVAHGSSVAYPPSVFGWFCTCSNKTQDIHVRS

SEQ ID NO: 233495 - protein, 244 aa, Glycine max
  Coding DNA Sequence Number=SeqID_116717
  Gene Ontology: Mol. function=hydrolase activity; Cellular component =cell surface; Biological process=nylon catabolic process
  Homolog annotation: Hit_ID=Q2T577; Match level="QueryCoverage=94%, HitCoverage=48%, E-value=1e-67, Identity=58%"; Hit description=6 -aminohexanoate-cyclic-dimer hydrolase
  Pfam annotation: Domain name=Amidase; Domain location=28-243; Score= -44.7; E_value=8.9e-10; Accession=PF01425.11; Description=Amidase
MMKLSEYVSYDALGLAELVRRGEVSAAALQQAARAAVEAVNPAINAVVEHWEQPPEQDDGPLSGVPFLIKDIAISMAGKRVELGSRLAQGSVAAADSHLMSNIRRAGLVTFGRTSTPEMAFSTTTEAVLYGATRNPWNLDFSAGGSSGGAGAAVAAGMVPIAHATDAAGSIRVPASSNGVFGLKPTRGRVPHGPVMDEVFNGFGVQLGLSRTVRDSAALLDAMQRPHVGEPYSRRRRRTAGYRR

SEQ ID NO: 233496 - protein, 187 aa, Glycine max
  Coding DNA Sequence Number=SeqID_116718
MSCLVIITPIFPCRSVNWCMPPTRHLLDSDKSNRALGFPALITSLCQSFGVPVTPSKVIRPPITRAFIEKYCTPRQAQGDAPQAANAPPPPHQADPTGSLGMERYLQHLVQIHECLYQLSLSQQGQGFIPFACPTPDQFRAEVAWPRDWPEAQAGEAPAEAPGDAEEARMDEEMTNLLGFLRGTGAT

SEQ ID NO: 233497 - protein, 103 aa, Glycine max
  Coding DNA Sequence Number=SeqID_116719
METDVYIKKYKTCDYRLKSFKATVIQKKSTNIYSDLVLQKLMKLAFGEREGEKTCQRKTERESIGWRDQTKIAQIKIEMLMNESLNSHAVECNMMPNTDISAY

SEQ ID NO: 233498 - protein, 299 aa, Glycine max
  Coding DNA Sequence Number=SeqID_116720
  Gene Ontology: Mol. function=protein binding; Cellular component=1 -2nm peptidoglycan-based cell wall; Biological process=barrier septum formation
  Homolog annotation: Hit_ID=Q4UTA8; Match level="QueryCoverage=67%, HitCoverage=88%, E-value=1e-49, Identity=55%"; Hit description=Cell division protein zipA homolog
  Pfam annotation: Domain name=ZipA_C; Domain location=166-282; Score =125.2; E_value=1.8e-34; Accession=PF04354.4; Description=ZipA, C -terminal FtsZ-binding domain
QRRPPGQHGQGNERKGAVPVRQPQQGDDGGRAPVVGRDHARAGRQPPGQRGPGRSRAIGGRGLTRRTYRMSDTALLRIGILAAGLLLIAAIFLFGRPKKKPQGRRVESAEPNSGERREPVLGEDGVTVADGRVEPGMGTEGEQAELGLGETDPGASDLGKRATQDFDKIVSLHRGGGRKDRPGVRPHERVPPPGGGHPERGPIFSMASIMKPGSFDMANIRAMETPAIAFFLTLPAPLTALDAWEKMLPTVQRMAELLDGVVLDDSRNALGRQRIAHIRDELRAYDRQHQAPPLTKTPR

SEQ ID NO: 233499 - protein, 107 aa, Glycine max
  Coding DNA Sequence Number=SeqID_116721
SEPPRNVSNLHGDEEDDDDDYLVSNSYIEESLDEDDSVDRISDTNDEVTDMIQPKEFKIHFGMMLCIITISTGVILMRRTFAVWRCHRVLMLGKNYMLAWILIVKMW

SEQ ID NO: 233500 - protein, 73 aa, Glycine max
  Coding DNA Sequence Number=SeqID_116722
MSLSLQSQGFTSFPCSTPDQFKAEVAWPGDWPEAQAGESPAGAPAEAPDEADEAREGEEMTDLLDFLGGSDAT

SEQ ID NO: 233501 - protein, 35 aa, Glycine max
  Coding DNA Sequence Number=SeqID_116723
MPTSSRRLGDSSPESYSLHPATVILLPRTRFLIIT

SEQ ID NO: 233502 - protein, 245 aa, Glycine max
  Coding DNA Sequence Number=SeqID_116724
  Gene Ontology: Mol. function=cyclin-dependent protein kinase regulator activity; Cellular component=nucleus; Biological process =regulation of progression through cell cycle
  Homolog annotation: Hit_ID=P42751; Match level="QueryCoverage=56%, HitCoverage=40%, E-value=1e-34, Identity=50%"; Hit description =Cyclin delta-1
  Pfam annotation: Domain name=Cyclin_N; Domain location=51-185; Score =124.7; E_value=2.6e-34; Accession=PF00134.13; Description=Cyclin, N -terminal domain
MSLDSSSNHPIIPDLYCSEVTSEVIHLDSDDEAMKLNVLWGDSDHDDSDESILLSLLESEHDQVQEQTKSLGQQLRKKTWLINAREEAINWILKVHAYYSFKPETAYLSVDYFNRFLLSHTLTPDKAWPLQLLSVACLALAAKMEERKVPLLLDLQVIESRFLFKPKTVQRMELLVMASLKWRLRTITPFDFVHLFIAKLPCSASTWRDLSYIVSRVSDVIIRTCLGIKTLYPYKSLSTCNIFFL

SEQ ID NO: 233503 - protein, 178 aa, Glycine max
  Coding DNA Sequence Number=SeqID_116725
  Gene Ontology: Cellular component=microtubule
  Homolog annotation: Hit_ID=Q9FJW1; Match level="QueryCoverage=99%, HitCoverage=99%, E-value=6e-34, Identity=45%"; Hit description =Arabidopsis thaliana genomic DNA, chromosome 5, TAC clone:K9I9
MGNCQAAEAATVVIQHPGNKIERVYWSLSAHEVMNSNPGHYVALVVSSPTLMAENGTPMKQLKLLRPDDTLHIGQVYRLISFEDVLKEFASKKCGKLGKLLKETGSHGIQMKHKDSRALNPSRNSKSEFGSIKVEQEIQRMGNNGRSNNNNKKGVGRPFVGSGGQWRPALQSIAEIGT

SEQ ID NO: 233504 - protein, 115 aa, Glycine max
  Coding DNA Sequence Number=SeqID_116726
  Homolog annotation: Hit_ID=Q1SYR3; Match level="QueryCoverage=51%, HitCoverage=2%, E-value=2e-17, Identity=66%"; Hit description=RNase H, putative
MYPEVQKNPRAFFSSSTPILLEPLAHGSSDCSLPREDCIMNPPVLMPPVPGRPLILYMTVLDESMGCMLGQHDDSEKREWAIYYLSKKFTACEMNYSLLERTCCALLCSSHRLRQ

SEQ ID NO: 233505 - protein, 117 aa, Glycine max
  Coding DNA Sequence Number=SeqID_116727
HLTETSMRAGNSDIYGFLEPQSIQRSGHSQFETESYIKSWKKSSKRDVYLRAYLNRSDNYLKGIINRQKGSTKCGYYVMHWMFTIILGSFRNNWEATITAREIKGTADPVGTVLSLS

SEQ ID NO: 233506 - protein, 103 aa, Glycine max
  Coding DNA Sequence Number=SeqID_116728
KRSFAIGAGAVTLFGYSKDRDGQWLKKDTLPLQDERTLSPPPQRDDSSALMNEVLSELRGLRTYVGERFDSLDGRFEGMDTRITQLEEDVTYLRRCFDLPPLS

SEQ ID NO: 233507 - protein, 133 aa, Glycine max
  Coding DNA Sequence Number=SeqID_116729
MAPLPSLQNGQVTKSNTTYTLREFPERFTKDRIRLHELSPLSKGRPHLPNFTTKVVWILSQHALLRASERDSRVRFPKEERCAESPPTFICGKRRKNRRKPVKMKILSSGVVFTFEEGISTSHVCLKGQQPIF

SEQ ID NO: 233508 - protein, 180 aa, Glycine max
  Coding DNA Sequence Number=SeqID_116730
  Homolog annotation: Hit_ID=Q1SKD7; Match level="QueryCoverage=81%, HitCoverage=37%, E-value=2e-12, Identity=30%"; Hit description =Ankyrin
MALKKLSMKRSRRDATGEESSADPEFDSHRFRSAEHQQRFEAIRGWSFHRERRVQLREDEYTDFQEEIARKRWTPLVTPMAKFDPEIVLEFYASAWPTEEGVRDMRSWVRGQWIPFDVDSLSQFQGDPLVLEEGHKCEFSQKRNRANDFDKEAIAQLFAYRGRISPGPLQGGGCGSCTPA

SEQ ID NO: 233509 - protein, 57 aa, Glycine max
  Coding DNA Sequence Number=SeqID_116731
MATPNAPFAPQWNEFSAETEQAEAGRQRGGRRNPDRQARRWDRPCCTSSRHHGHHND

SEQ ID NO: 233510 - protein, 145 aa, Glycine max
  Coding DNA Sequence Number=SeqID_116732
  Gene Ontology: Mol. function=transferase activity, transferring acyl groups, acyl groups converted into alkyl on transfer; Biological process=carboxylic acid metabolic process
  Homolog annotation: Hit_ID=Q30DX9; Match level="QueryCoverage=99%, HitCoverage=20%, E-value=3e-45, Identity=78%"; Hit description=2 -isopropylmalate synthase 1
  Pfam annotation: Domain name=HMGL-like; Domain location=2-144; Score=- 89.4; E_value=0.012; Accession=PF00682.9; Description=HMGL-like
MSKDKVVDIARNMAKFARSLGCDDVEFSPEDARRSDREFFYEILGEVIKVEATTLNIPDTVGITKSSEFGKLIADIQANNPGIENVIISTHCQNDLGLSTANTIEAGRVNSEFVCSWMLLGCACWCKATGGDGLMGLVKGLEMPP

SEQ ID NO: 233511 - protein, 105 aa, Glycine max
  Coding DNA Sequence Number=SeqID_116733
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P09044; Match level="QueryCoverage=64%, HitCoverage=14%, E-value=5e-17, Identity=67%"; Hit description =Glyceraldehyde-3-phosphate dehydrogenase B, chloroplast precursor
MDGPGAGKHIQAGAKKVIIITAPAKGVDIPTYVVGVNERDYTHEISNIISSRKQMHQAVCVSKKVKTMIRSQTQANIKWTNLARKLQFEKFNRHAAAIEVLDITV

SEQ ID NO: 233512 - protein, 69 aa, Glycine max
  Coding DNA Sequence Number=SeqID_116734
MEKGTREGEDKRTKRELELGLGLKRKGQRGREWERDRRSGDTVDAPVVKNDFHSSESFSATERESHGLV

SEQ ID NO: 233513 - protein, 155 aa, Glycine max
  Coding DNA Sequence Number=SeqID_116735
  Homolog annotation: Hit_ID=Q75KB0; Match level="QueryCoverage=93%, HitCoverage=89%, E-value=3e-12, Identity=38%"; Hit description =Expressed protein
MTKQKERRKESKLSRYMKAPLRFLKKARDMYVYGMIECSGQLSYVEASMGCPTGQLCTLPRSFSVGSATRSAASDEDFEELVRAASLRSYGGRVVFGDAAAAAVEMKMPRSRSVGIGRIDEDKVCEFGDDGIKVRPNAYPRSKSYAACRDGAGLF

SEQ ID NO: 233514 - protein, 124 aa, Glycine max
  Coding DNA Sequence Number=SeqID_116736
  Subcellular localization annotation: CTP_CleavageSite=44; ConfidenceScore=5.03e-01
MTPPTMHPLDPDKSNRALGFSALITGLCQSFRVPVSPSKYCTPRQAQGDAPQTADTPPPPHQADPAGSLGVERYLQDLVRGRNFWRYGSQLFRHRFVFVTYYFAHLPCGSAGREIDRPNGVSLE

SEQ ID NO: 233515 - protein, 198 aa, Glycine max
  Coding DNA Sequence Number=SeqID_116737
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=95%, HitCoverage=34%, E-value=9e-75, Identity=59%"; Hit description=E3 ubiquitin ligase PUB14
  Pfam annotation: Domain name=Arm; Domain location=139-179; Score=9.7; E_value=0.74; Accession=PF00514.13; Description=Armadillobeta-catenin- like repeat
  Pfam annotation: Domain name=Arm; Domain location=16-56; Score=50.6; E_value=5.1e-12; Accession=PF00514.13; Description=Armadillobeta -catenin-like repeat
  Pfam annotation: Domain name=Arm; Domain location=57-97; Score=26.8; E_value=7.5e-05; Accession=PF00514.13; Description=Armadillobeta -catenin-like repeat
  Pfam annotation: Domain name=Arm; Domain location=98-138; Score=28.1; E_value=3.1e-05; Accession=PF00514.13; Description=Armadillobeta -catenin-like repeat
  Pfam annotation: Domain name=DUF634; Domain location=7-177; Score= -143.1; E_value=0.0067; Accession=PF04826.4; Description=Protein of unknown function (DUF634)
  Pfam module annotation: Pfam domain module=Arm::Arm::Arm::Arm::DUF634; Domain location=139-179::16-56::57-97::98-138::7-177
QQKAAGGELRLLGKRNADNRVCIAEVGAIPPLVDLLSSSDPQTQEHAVTALLNLSINESNKGTIVNVGAIPDIVDVLKNGNMEARENAAATLFSLSVLDENKVQIGAAGAIPALIKLLCEGTPTGKKDVATAIFNLSIYQGNKAKAVKAGIVAPLIQFLKDAGGGMVDEALAIMEILASHHEGRVAIGQADRGRTRIK

SEQ ID NO: 233516 - protein, 72 aa, Glycine max
  Coding DNA Sequence Number=SeqID_116738
  Homolog annotation: Hit_ID=Q9FKU9; Match level="QueryCoverage=63%, HitCoverage=9%, E-value=3e-07, Identity=55%"; Hit description =Berberine bridge enzyme-like protein
  Pfam annotation: Domain name=BBE; Domain location=28-65; Score=38.2; E_value=2.9e-08; Accession=PF08031.2; Description=Berberine and berberine like
MAWFSVVWTKINITPPVEVLLNTQPQSVNYLKRKCDYVKDNFNKLVEINTKVDPDNFFRNEQSIPMLSYQKL

SEQ ID NO: 233517 - protein, 176 aa, Glycine max
  Coding DNA Sequence Number=SeqID_116739
  Subcellular localization annotation: CTP_CleavageSite=23; ConfidenceScore=5.06e-01
MRNKIKNPNVMVTPLFSVRPLVVDNHRATLFVAIMGEISFILVCKTTSPQRVTTTPPLVAMNHHKSTLSQMSSLSSGMPKRLSQFRSLIRVLRVWSLESKMESKRKREITLTIMKCKKKNREKAMKKRRKLEIDNGGDESSGPTLVMRTYGSRRQSRAQAHIVTTNSDRRWRRPQL

SEQ ID NO: 233518 - protein, 151 aa, Glycine max
  Coding DNA Sequence Number=SeqID_116740
MIERIRFHGLPLEDLVLHLRKFLKLTNTVKSPTNALDYIKLAAFPFSLRGKAKDWPRDLPRGNLMHKLTDATMEIIEVMVSNAYNGVGDKDFSGNPLEFIKWKLIHLILLFNKRWICWPKDGDYDESSSVDDDTHSPTSCLRRVYEDITYG

SEQ ID NO: 233519 - protein, 349 aa, Glycine max
  Coding DNA Sequence Number=SeqID_116741
  Gene Ontology: Mol. function=hydrolase activity, hydrolyzing O -glycosyl compounds; Cellular component=periplasmic space; Biological process=carbohydrate metabolic process
  Homolog annotation: Hit_ID=Q8PFV3; Match level="QueryCoverage=92%, HitCoverage=44%, E-value=1e-152, Identity=85%"; Hit description=Beta- glucosidase
MVSFSHRMRRTPSSQHRHWHLAALDQARQVLGVEAALHAQVQAGGERLGGGIAVVGGIAVRDQFHVGGVVGNHHARELPFAAQDVGQQFGVGTGRHAVDVVERGHHGDRAGIESGLERRQMHVAQGLRRDVHHVVFHAGHHRAVGGEVLRRGQQRIGGAQVAALEAAHAGGGERTAQHHVLTGTFGATAPALVAGDVHGRGIGPVQAGSGGFDGGGARGALGQVRFEAGGLAQRDREHGTHAVDDVGSQDHRDAQAAFLGGDLLDAAAQFGADTIEQGPDLALAHLLQHLVGIAHVGFRVHVRGERADHVCEDTQLADLFLDGHLGNEGFDAIGGHRQSLMKTFTSPAF

SEQ ID NO: 233520 - protein, 113 aa, Glycine max
  Coding DNA Sequence Number=SeqID_116742
MDGILISSVVLLADSRFTRPDMGFHPTKLNFVPSDADEAPLDVSICLHAFGIVGCDPFHPGLFVGDAGGFQSPTREPLNVGGLVPPHCSLKSVVSDDACPGACFVQRDATTLS

SEQ ID NO: 233521 - protein, 199 aa, Glycine max
  Coding DNA Sequence Number=SeqID_116743
  Gene Ontology: Cellular component=membrane
  Homolog annotation: Hit_ID=Q8ZL13; Match level="QueryCoverage=83%, HitCoverage=65%, E-value=2e-57, Identity=64%"; Hit description =Integral membrane protein
MADASIWFDFLNTHAPDTAYGFYRRAGRNGQALFCDKRQRLRYAYCAGVAPLLSTVFCCKLAVFSRLLRLTGGVHRAGGEDLSGLRYESNLPADARHRPTAGGADQRPGARRSSLLAGLSRTRDLAGATERLFDLRIYAGGRHRGAALGHCAGLHAVDLLYDRFLPAELGDGGASALSLWLPASALDTGAARAASVPWA

SEQ ID NO: 233522 - protein, 95 aa, Glycine max
  Coding DNA Sequence Number=SeqID_116744
IPPTAPIEFPNVRETEKRLKPPLVLSSCDSFFSIHEYYLANPNGERKGYNAKGISLSLNMISKFPTVRWPAGKREGFGRREKKRNCEAEETEESV

SEQ ID NO: 233523 - protein, 92 aa, Glycine max
  Coding DNA Sequence Number=SeqID_116745
MNSSFEGPKGMSRGWKRLEDKHVKVSALQVEMEARERVIKSLHGEAVKWMDRFALTLNGGCRNLPFGGRATRDSRDACSMKGIRAESPPTFI

SEQ ID NO: 233524 - protein, 186 aa, Glycine max
  Coding DNA Sequence Number=SeqID_116746
MKWQRPPTISDLLHGLNHRLRAHSSLSLLDSVMAFNPEEAQEAFEQFLIIMDDQIEWLIEQAQQRGVDLDGSLESLDRLETLYTLMAATLSKDEQAALRVVFARYLGETVCQHHGGKWTLPLDDPKDISFNMPVIVGHSSCPWLEFNPIHTMRAYSLRPKPGMIQSVVAHSIAPRILDLSDLVEED

SEQ ID NO: 233525 - protein, 72 aa, Glycine max
  Coding DNA Sequence Number=SeqID_116747
MAWIYCPGSGMIHRSRSWKTDGHRPDRTPADRDRPSDGLGGRLFQLGHHRVQRTHRGVTGHAGPALAGQPGT

SEQ ID NO: 233526 - protein, 45 aa, Glycine max
  Coding DNA Sequence Number=SeqID_116748
MCKWKGRARWSPGTEGKRPVVAPLSRVLLPWKAQVRFGGKKVEKM

SEQ ID NO: 233527 - protein, 219 aa, Glycine max
  Coding DNA Sequence Number=SeqID_116749
  Gene Ontology: Mol. function=transferase activity; Cellular component= membrane
  Homolog annotation: Hit_ID=Q7CIL3; Match level="QueryCoverage=61%, HitCoverage=34%, E-value=2e-61, Identity=77%"; Hit description =Putative heat shock protein
MLETCYQRLEQPDSWAQFLQRCVEENSGAAAELYLADILEQQQGPEAAQLYINRQLQRHPTMRVFHRLMDFHLHEAEDGRAKESLMVLRDMVGEQIRTKPRYRCQKCGFTAHALYWHCPSCRAWSSVKPIRGLDGQEIIIHASALCITSSISKAIAVATLSWQGCTGRMLAVCPSRLRVPASEETLCLLLTHRFWWHSTIMISIAHCSSLTVSIRASAV

SEQ ID NO: 233528 - protein, 116 aa, Glycine max
  Coding DNA Sequence Number=SeqID_116750
MSAVDVEVQGVRGKGEVEVIEDVPRLGEDGEVLAVGGQLLPLWNDDGGLQEGIQRLSVEFNDLTPHPTLFFRAVLRCGVQLHVPLGKTVLEVNIVSVSKTSDLRDKTGGIPCGFPL

SEQ ID NO: 233529 - protein, 50 aa, Glycine max
  Coding DNA Sequence Number=SeqID_116751
MRSIKLGSGLITRNEDDEGPLSPWFKGTRSSPEVIPCIQERNNYNKGYQG

SEQ ID NO: 233530 - protein, 55 aa, Glycine max
  Coding DNA Sequence Number=SeqID_116752
MVFNFDRDQQTTRLIVSAISSTVVVNLKATGADSILKLSKFKWLFISEPLAMLLF

SEQ ID NO: 233531 - protein, 142 aa, Glycine max
  Coding DNA Sequence Number=SeqID_116753
MEQQSPSHNLFQTNVTYVISLVGKGQGLRWYLDCECLQHMTRERSMFLNLKPHEGGAVSFGGIGKGKISGIEKFIHVKFNDGLMSNRKLSDLEDDFANMKIGSYVSPKEKEIKQSKEILPQIKESSYHKPQMKDWKFVHHHP

SEQ ID NO: 233532 - protein, 102 aa, Glycine max
  Coding DNA Sequence Number=SeqID_116754
MKEDAKIFILAGKLSDEIPNEVIMEYLKTLSIEEEQRLRMFGWKNQRDFNLQENLQHKLSLDATKRQAEIYVAIVPNNMDSTERETLEEGMLQSVIKASLME

SEQ ID NO: 233533 - protein, 100 aa, Glycine max
  Coding DNA Sequence Number=SeqID_116755
MCKARLEWKPHTLMKGVFWRVYGWMMMPSSTLNISGQCEVAYGIIDYKEETLSGKTDTHNIFTNKQSYKKRMRFHLQSKSLIRIEEYTTECWRRINGLQQ

SEQ ID NO: 233534 - protein, 75 aa, Glycine max
  Coding DNA Sequence Number=SeqID_116756
MVTSILQLDLMNLFVKARAWFNPITQGMAILIANTSTTFHRDERLGNTHAMENKWVYDPNMVGSWYLTHATKNAS

SEQ ID NO: 233535 - protein, 84 aa, Glycine max
  Coding DNA Sequence Number=SeqID_116757
MGEVEEVQEKIKADMEAMKEQMGTMMEAMMIMKKIMEASAVAVAATSTIAKVNPMPPSGLNQMNHPTSAMVGKGLGSMGGPHDV

SEQ ID NO: 233536 - protein, 72 aa, Glycine max
  Coding DNA Sequence Number=SeqID_116758
MVWLQQLMMVTIWVQQQEMVWLQQLRMVMVWMMSMLLFVTILLLHNVTSSALLSPSLYYHERMGVGMDHNLQ

SEQ ID NO: 233537 - protein, 127 aa, Glycine max
  Coding DNA Sequence Number=SeqID_116759
  Homolog annotation: Hit_ID=Q1T097; Match level="QueryCoverage=64%, HitCoverage=7%, E-value=4e-16, Identity=47%"; Hit description =Transposase family tnp2, putative
MDARYEQFDPFIVAHKARKVYYIPLATLTDKRGWCVGIKTKPRGFIESDDVEDDVPYQEGSPSHTNKVNEVEGIFGLHDVEGDAKELDVPEEPPQHVQVQEEEEELVENNQDEELKDDFDVSSSEED

SEQ ID NO: 233538 - protein, 131 aa, Glycine max
  Coding DNA Sequence Number=SeqID_116760
  Gene Ontology: Mol. function=calcium ion binding; Cellular component =flagellin-based flagellum; Biological process=ciliary or flagellar motility
  Homolog annotation: Hit_ID=Q2HVQ3; Match level="QueryCoverage=68%, HitCoverage=82%, E-value=2e-40, Identity=89%"; Hit description =Calcium-binding EF-hand
  Pfam annotation: Domain name=efhand; Domain location=64-92; Score =19.0; E_value=0.017; Accession=PF00036.22; Description=EF hand
MELDYGFDFEDCFPSMIARLGAEGFIGELCNGFRLLMDVNMGLITFESLKMSTNLLGLEVRDDELLCMLMEGDLDGDGALNQMEFCILMFRLSPCLMDMQGMKNTQLRDSHSTFPSLFLVFYLPNVKGAES

SEQ ID NO: 233539 - protein, 246 aa, Glycine max
  Coding DNA Sequence Number=SeqID_116761
  Homolog annotation: Hit_ID=Q1SUI8; Match level="QueryCoverage=52%, HitCoverage=71%, E-value=6e-14, Identity=41%"; Hit description=Beta tubulin
MPWGQNRSVEVIRLFSLEPSWWEASKTLKMVEGYYGDSKEVWGLVFRKHKVEVGTGEDVRWVGRRESLGNGPSTGDANGSLGRYHCMVEDFMRPVQGSRRVKRHLVMELEHAEISQDFFKQLWKVPAPSKVLVFAWRCAHNRVQTKKELRCQHHMQETSHLFFACNFSYKQEMGKRLSGLYGWLFYGHYGWQEMISASINGCKLLPEQVLDLAKMRPRSWLKGKMNSFSSSMYEWTVLPNLCLKGL

SEQ ID NO: 233540 - protein, 96 aa, Glycine max
  Coding DNA Sequence Number=SeqID_116762
MVGSWYLTHATKNARKMQGSSMSKHDNKRHESPENHLFLLAHSGAQCPMCAVKKVIWTFRLPVTKDETNIQRMRDDMMQMHKSKIEGCTQHDNILK

SEQ ID NO: 233541 - protein, 331 aa, Glycine max
  Coding DNA Sequence Number=SeqID_116763
LDPQELIARLCIPGRGFELNADGLPLKILRKNLTTMAQTWSVLSFSNLALTSHTSDITLDRARLIYELIMKMDMNLGSLISGQISLIAQHDSSRLGFPALITALCKARGVTSDSLTFESLSPAINLTYIKKNCWNLDDPSVIFPGTHKSRARGSKALSISSPPDTTAPSTSAPATSILPSPLIAPVPLASSTPSSDPIMTMLKSLHQGQLLIMQSLQDVAWPGVQPSPLGGGEASAAQKPQPDQEDDSLESSEPSAPKPSPFTFDIDPVIMQEDDAAVTPQVTPQPPSEPSKSVLDMSSQPEPSVPEPDQHLSQDSPSVPALDLNEHAEDH

SEQ ID NO: 233542 - protein, 113 aa, Glycine max
  Coding DNA Sequence Number=SeqID_116764
KRGYISCGSVQVEGTSTWLFKENKGVYIPCGSLACKGFYKVERNLKNLRPLDPTVPKMDVVLSELNLLSECHSLSEASARLVDRRNLEGNLLCKPSLNSLSAHSASHLSPSQA

SEQ ID NO: 233543 - protein, 51 aa, Glycine max
  Coding DNA Sequence Number=SeqID_116765
MAEITKGWKRMEDRIATDQAPPLPGAKPAENVAARQPSILCVRSFFYYCLF

SEQ ID NO: 233544 - protein, 165 aa, Glycine max
  Coding DNA Sequence Number=SeqID_116766
MAQLHHAVADQACDLIPYGFNLLFRERHGLPRKHKKQAISISSGFYAQYLRCRKAGENIMNWVETFTEYYRLSRTGRGALGLFAGVAGADRAAAAVSRAPAFGRRRFAGLTEGYRRPAQQQQRQADQQQHHHHSTELGAHAFCCHVVSPLAEIPSTGEDDEEKRH

SEQ ID NO: 233545 - protein, 60 aa, Glycine max
  Coding DNA Sequence Number=SeqID_116767
  Homolog annotation: Hit_ID=Q1SMP6; Match level="QueryCoverage=84%, HitCoverage=15%, E-value=7e-20, Identity=88%"; Hit description=Dilute
  Pfam annotation: Domain name=DIL; Domain location=1-58; Score=-14.2; E_value=0.046; Accession=PF01843.9; Description=DIL domain
LLRRECCTFSNGEYVKSGVAELEKWIVNATEEVIHQKRKKSLEEIRLDLCPAKHLTWELG

SEQ ID NO: 233546 - protein, 78 aa, Glycine max
  Coding DNA Sequence Number=SeqID_116768
MLRTGGRAGDQDSGVHIGSRGAVNTGDQGYNSLHMREKAIKKREKISWRGKAVEGNKERHKNIPFWRSHYLKASITGK

SEQ ID NO: 233547 - protein, 574 aa, Glycine max
  Coding DNA Sequence Number=SeqID_116769
  Gene Ontology: Mol. function=transferase activity, transferring glycosyl groups; Biological process=response to oxidative stress
  Homolog annotation: Hit_ID=Q60EW9; Match level="QueryCoverage=93%, HitCoverage=68%, E-value=1e-136, Identity=48%"; Hit description =Putative anthranilate phosphoribosyltransferase
  Pfam annotation: Domain name=C2; Domain location=220-299; Score=33.0; E_value=1e-06; Accession=PF00168.20; Description=C2 domain
  Pfam annotation: Domain name=C2; Domain location=389-478; Score=70.9; E_value=3.9e-18; Accession=PF00168.20; Description=C2 domain
  Pfam annotation: Domain name=C2; Domain location=63-138; Score=13.0; E_value=0.016; Accession=PF00168.20; Description=C2 domain
  Pfam module annotation: Pfam domain module=C2::C2::C2; Domain location=220-299::389-478::63-138
METNLKVFMAAFLLRKLYIFSRKLSKVQRRLITYLHMGIVGFDIEGDKLTRVHDLVEQMEEFLFVRVVRIRDLPPNIDYYVEVMVGDLIASTLLFISPEWNQVFAFQKEKISDESVSIFLKDKRLAKSMPEAFLAQVRFSIDDVPTRVPQESSTLAPQWYKLEGPNGRLVRGEIMLCLWMGTQEDESFPNAWCSNATTVSGDDIVYTRSKVYISPTLWYLRVNVIQAQGMELELVGESDLFFVQVDLGGQHLRTKLSKGPNPLWNEDLVFVAQEPFSETLVLSVKKLTPDKKITLGKHWLHLKDVNKRLEEEEVDSKWYNLGRLTDSRWYNNLGRPKIPDNTREVEYVGKINARISLDGAYHVMDEPSEYCSDFRPSSKELWSSSIGVLEVGIQKATALVPMKSGGTRTDAYCVAKYGPKWARTRTVVNSLSPKWNEQHAWEVYDPFTVITIAVFDNNQLDAGSRARGEKDATMGKIRIRLSTLENDKVYALSYPLVGVNPSGVKKMGEIHLAVRFSWSFRCPIKMYEYYMSPLLPLHHHVFPLLPSQLHALRNQPAQIIAQRLSRAEPPLREE

SEQ ID NO: 233548 - protein, 175 aa, Glycine max
  Coding DNA Sequence Number=SeqID_116770
  Homolog annotation: Hit_ID=Q9LU39; Match level="QueryCoverage=57%, HitCoverage=42%, E-value=1e-29, Identity=63%"; Hit description =Arabidopsis thaliana genomic DNA, chromosome 3, P1 clone: MXL8
MALPCSASVPLTTLTSPLLFMFRKRFGEEVDQDFIYIIAVDRILQLEDIQEDGIWVTSSDYKNAQPDPLRDSAHNLVTEINTNNMEDITRFCNVYVDLDFLHISLFGGHSTDEVHKNRRLNFPESRMPKIVCDPNEDDSSCRNSNCHKETNTTKQQKYCCSSSIPPSDKSLQLLS

SEQ ID NO: 233549 - protein, 564 aa, Glycine max
  Coding DNA Sequence Number=SeqID_116771
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=90%, HitCoverage=50%, E-value=0.0, Identity=73%"; Hit description=ERECTA
  Pfam annotation: Domain name=LRR_1; Domain location=26-47; Score =10.0; E_value=3.8; Accession=PF00560.23; Description=Leucine Rich Repeat
  Pfam annotation: Domain name=LRR_1; Domain location=49-70; Score=7.9; E_value=9.6; Accession=PF00560.23; Description=Leucine Rich Repeat
  Pfam annotation: Domain name=Pkinase; Domain location=174-449; Score =102.9; E_value=9.2e-28; Accession=PF00069.15; Description=Protein kinase domain
  Pfam annotation: Domain name=Pkinase_Tyr; Domain location=174-449; Score=91.7; E_value=2.2e-24; Accession=PF07714.7; Description =Protein tyrosine kinase
  Pfam module annotation: Pfam domain module=LRR_1::LRR_1::Pkinase::Pkin ase_Tyr; Domain location=26-47::49-70::174-449::174-449
MLLCHSDLSDNQLSGFIPEELSQLQNMISLRLENNKLTGDVASLSSCLSLSLLNVSYNKLFGVIPTSNNFTRFPPDSFIGNPGLCGNWLNLPCHGARPSERVTLSKAAILGITLGALVILLMVLVAACRPHSPSPFPDGSFDKPINFSPPKLVILHMNMALHVYEDIMRMTENLSEKYIIGYGASSTVYKCVLKNCKPVAIKRIYSHYPQCIKEFETELETVGSIKHRNLVSLQGYSLSPYGHLLFYDYMENGSLWDLLHDMHGTLYLEGPTKKKKLDWELRLKIALGAAQGLAYLHHDCCPRIIHRDVKSSNIILDADFEPHLTDFGIAKSLCPSKSHTSTYIMGTIGYIDPEYARTSHLTEKSDVYSYGIVLLELLTGRKAVDNESNLHHLILSKAATNAVMETVDPDITATCKDLGAVKKVYQLALLCTKRQPADRPTMHEVTRVLGSLVPSSIPPKQLADLPPASNPSAKVPCYVDEYANLKTPHLVNCPSMSTSDAQLFLKFGEVISQNSEKDMYHHHHHNLKGEVNPILILVCWLWISYLSECWQYSEKSVYTLPLLG

SEQ ID NO: 233550 - protein, 386 aa, Glycine max
  Coding DNA Sequence Number=SeqID_116772
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=91%, HitCoverage=56%, E-value=1e-144, Identity=46%"; Hit description =ERECTA
  Pfam annotation: Domain name=LRRNT_2; Domain location=50-91; Score =36.4; E_value=9.6e-08; Accession=PF08263.3; Description=Leucine rich repeat N-terminal domain
  Pfam annotation: Domain name=LRR_1; Domain location=120-142; Score =13.7; E_value=0.68; Accession=PF00560.23; Description=Leucine Rich Repeat
  Pfam annotation: Domain name=LRR_1; Domain location=144-166; Score =14.7; E_value=0.34; Accession=PF00560.23; Description=Leucine Rich Repeat
  Pfam annotation: Domain name=LRR_1; Domain location=168-190; Score =6.7; E_value=16; Accession=PF00560.23; Description=Leucine Rich Repeat
  Pfam annotation: Domain name=LRR_1; Domain location=192-214; Score =16.9; E_value=0.073; Accession=PF00560.23; Description=Leucine Rich Repeat
  Pfam annotation: Domain name=LRR_1; Domain location=216-238; Score =14.2; E_value=0.49; Accession=PF00560.23; Description=Leucine Rich Repeat
  Pfam annotation: Domain name=LRR_1; Domain location=239-260; Score =10.4; E_value=3.3; Accession=PF00560.23; Description=Leucine Rich Repeat
  Pfam annotation: Domain name=LRR_1; Domain location=263-285; Score =15.2; E_value=0.24; Accession=PF00560.23; Description=Leucine Rich Repeat
  Pfam annotation: Domain name=LRR_1; Domain location=287-309; Score =18.9; E_value=0.019; Accession=PF00560.23; Description=Leucine Rich Repeat
  Pfam annotation: Domain name=LRR_1; Domain location=311-333; Score =8.0; E_value=8.9; Accession=PF00560.23; Description=Leucine Rich Repeat
  Pfam annotation: Domain name=LRR_1; Domain location=335-357; Score =16.1; E_value=0.13; Accession=PF00560.23; Description=Leucine Rich Repeat
  Pfam annotation: Domain name=LRR_1; Domain location=359-381; Score =12.2; E_value=1.5; Accession=PF00560.23; Description=Leucine Rich Repeat
  Pfam annotation: Domain name=LRR_1; Domain location=96-118; Score =4.7; E_value=38; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=50-91::120-142::144-166::168-190::192-214::216 -238::239-260::...
  Pfam module annotation: Domain location=263-285::287-309::311 -333::335-357::359-381::96-118
MAFRFGVLILALLICLSVNSVESDDVVKVVNFHIVRMNYVTSFTDVKVVNFQHGATLLEIKKSFRDVDNVLYDWTDSPSSDYCAWRGIACDNVTFNVVALNLSGLNLDGEISPAIGKLHSLVSIDLRENRLSGQIPDEIGDCSSLKNLDLSFNEIRGDIPFSISKLKQMENLILKNNQLIGPIPSTLSQIPDLKILDVRNNSLTGSIPENIGNCTAFQVLDLSYNQLTGEIPFNIGFLQVATLSLQGNKLSGHIPSVIGLMQALAVLYLHGNKLTGFIPPELGNMSKLHYLELNDNHLSGHIPPELGKLTDLFDLNVANNNLKGPIPSNLSSCKNLNSLNVHGNKLNGSIPPSLQSLESMTSLNLSSNNLQGAIPIELSRIGNLDT

SEQ ID NO: 233551 - protein, 178 aa, Glycine max
  Coding DNA Sequence Number=SeqID_116773
MVVDVCQCFCGGWQSRHLPLTVELIETKTASTVWSSVSNDLPWTNFLTPLDSPQYTVYGGPAALNFFFLPPSISTVNNTVTRKPNSKIETVAFRGRGNSMTYRSVLYAVGLQIRHSHRQGPNLSCMLTAPRSVTHATDGRGRSKLWVNKAVVALDVDVDPTAREAGTVELAEAKDNTL

SEQ ID NO: 233552 - protein, 149 aa, Glycine max
  Coding DNA Sequence Number=SeqID_116774
MRWLSPPLCRLVDGDAGDGSPELWRRTAENAPQKAKYCWKEGQQAEKSTRMWKQSLKTGDKQKGPPGTARYREKEERETKWMLEEVIKGDLILNKIPEMMAFNCAECVTAVGHYKKLSNTLSDRGGTSPSNDPLQGIGGHMTRSKTKRM

SEQ ID NO: 233553 - protein, 92 aa, Glycine max
  Coding DNA Sequence Number=SeqID_116775
  Homolog annotation: Hit_ID=Q1SMP6; Match level="QueryCoverage=87%, HitCoverage=22%, E-value=1e-26, Identity=76%"; Hit description=Dilute
  Pfam annotation: Domain name=DIL; Domain location=10-90; Score=33.7; E_value=6.2e-07; Accession=PF01843.9; Description=DIL domain
  Subcellular localization annotation: CTP_CleavageSite=60; ConfidenceScore=5.48e-01
MKVPSFFIRKLVTQVFSFINITLFNRSSFFSLLLRRECCTFSNGEYVKSGVAELEKWIVNATEEVIHQKRKKSLEEIRQDLCPVKHLTWELG

SEQ ID NO: 233554 - protein, 289 aa, Glycine max
  Coding DNA Sequence Number=SeqID_116776
  Gene Ontology: Mol. function=nucleic acid binding; Biological process= DNA integration
  Homolog annotation: Hit_ID=Q0KIN0; Match level="QueryCoverage=51%, HitCoverage=10%, E-value=6e-17, Identity=35%"; Hit description =Integrase core domain containing protein
MASLGTTDTVSATTRADHLTTKAMDIPNKDWPVGGNKAKKVYSNDVHRLYSVITTMLSTKLENMDMQTYLGKLDRLIADYNNILLAPTVSTYDMVSEQLPCLSTPHVFGHSSTSASSTDSSALVSHSSHGRGHADCHNKARDQSKSTNVAQVTNPTPIEDTKSSNPVATVSQSSSLGPRILDSDASDHMKDGSQIKVCGSGQTHPLPNLPLNSVLFVPSCPFNLISISKDWRTEWTIGAGHESGGLYHLQPPIACVSIAFADLAHQRFGHPSLEKLRPLGASLSTLKSL

SEQ ID NO: 233555 - protein, 432 aa, Glycine max
  Coding DNA Sequence Number=SeqID_116777
  Gene Ontology: Mol. function=motor activity; Cellular component =myosin complex; Biological process=regulation of transcription
  Homolog annotation: Hit_ID=Q1SMP7; Match level="QueryCoverage=87%, HitCoverage=32%, E-value=1e-164, Identity=80%"; Hit description=IQ calmodulin-binding region; Myosin head, motor region; AAA ATPase
  Pfam annotation: Domain name=IQ; Domain location=120-140; Score=22.3; E_value=0.0017; Accession=PF00612.17; Description=IQ calmodulin -binding motif
  Pfam annotation: Domain name=IQ; Domain location=145-165; Score=25.2; E_value=0.00024; Accession=PF00612.17; Description=IQ calmodulin -binding motif
  Pfam annotation: Domain name=IQ; Domain location=168-188; Score=21.4; E_value=0.0032; Accession=PF00612.17; Description=IQ calmodulin -binding motif
  Pfam annotation: Domain name=IQ; Domain location=193-213; Score=26.3; E_value=0.00011; Accession=PF00612.17; Description=IQ calmodulin -binding motif
  Pfam annotation: Domain name=IQ; Domain location=216-236; Score=17.5; E_value=0.048; Accession=PF00612.17; Description=IQ calmodulin -binding motif
  Pfam annotation: Domain name=IQ; Domain location=97-117; Score=13.2; E_value=0.92; Accession=PF00612.17; Description=IQ calmodulin -binding motif
  Pfam annotation: Domain name=KH_2; Domain location=75-123; Score=0.7; E_value=0.099; Accession=PF07650.7; Description=KH domain
  Pfam module annotation: Pfam domain module=IQ::IQ::IQ::IQ::IQ::IQ::KH_ 2; Domain location=120-140::145-165::168-188::193-213::216-236::97 -117::75-123
  Subcellular localization annotation: CTP_CleavageSite=39; ConfidenceScore=5.43e-01
MYRSRPHFSLISSQTSPCLSSFRSTSSQTSLLPLSSLVTVAIYSTDCAWLLCYDDKAATEKILQKLKLENFQLGRTKVFLRAGQIGILDSRRAEVLDNAAKYIQRRLRTFIAHRDFILARAAAFSLQACCRGYIARKIYAAKRETAAAISIQKYIRMWLVRHAYFKLYFSAIIIQSHVRGFVTRQRLLHGKEHRAATFIQAYWRMSKVRSSFRRHQASIVAIQCLWRCRQAKRELRRLKQEANEAGALRLAKNKLEKQLEELTWRLHLEKKMRVSNEEAKKIEIFKLQKMLEALNLELDAAKLAKINECNKNAVLQNQFELSVKEKSALKRELVAVDELRKENALLKVSLGAFEKKCTTLELELMNAQKGRDETMEKLRESEQKCSQLEQNVKRLEEKLLSLEDENHVLRQKALSTPLLKSNRPSFAKSISE

SEQ ID NO: 233556 - protein, 247 aa, Glycine max
  Coding DNA Sequence Number=SeqID_116778
  Gene Ontology: Mol. function=motor activity; Cellular component =myosin complex; Biological process=signal transduction
  Homolog annotation: Hit_ID=Q1SMP7; Match level="QueryCoverage=78%, HitCoverage=19%, E-value=7e-93, Identity=77%"; Hit description=IQ calmodulin-binding region; Myosin head, motor region; AAA ATPase
  Pfam annotation: Domain name=Myosin_head; Domain location=1-247; Score=-315.4; E_value=0.00012; Accession=PF00063.11; Description =Myosin head (motor domain)
MARALLIVIPSFRYQEAIFRVLAAILHLGNIEFSPGKEHDSSVIKDEKSRFHMQMAADLFICDVDLLLATLCTRSIQTREGSIVKALDCNAAIAGRDALAKTVYARLFDWLVAKINRSVGQDINSKIQIGVLDIYGFECFKDNSFEQFCINFANEKLQQHFNEHVFKMEQEEYGKEEINWSYIEFVDNQDVSDLIEKVRDTEIARSVLEGSYSVSQKYVKTILSDPMPQVLDLKGFQKMKREKISDF
